United States Patent 8,535,880 (ORGAN-SPECIFIC GENE, METHOD FOR IDENTIFYING THE SAME AND USE THEREOF) - sequence listing, part 3

SEQ ID NO: 10022 - DNA, 542 bp, Rattus norvegicus
gaaggctcaccattgaggacctacttccgtcgcattgagtgtgggaagagatgcaaccgaatcaatctctacttttatattaagaaaggggccaagtgccaacagtttaaaatcgtgggaaggagatcccaagacgtttactatgcaaagtatgaagggagcacggcattcatgttaaagacagtgaatgagaagatattgctgtttgattattttaacagaaacagaagaaatgacgttacacgagtggctggagttttggcgaaaggcaggcaactgactaaggatgagatgacagaatacatgaacttcgtggaagaaatgggcattgaggatgagaatgtacaacgtgtcatggacacagacacctgtccaaacaagatcagaattagatgacatcaggaattttccactatattcttcctggaacctgaaacatcaatatgaagatgaagcaatcttttctttcagatcatatcttcctatttgctgcaaattacaattcttgtctccatactttctctttcattcatactttccca

SEQ ID NO: 10023 - DNA, 325 bp, Rattus norvegicus
  misc_feature (70)..(70): n is a, c, g, or t
  misc_feature (73)..(73): n is a, c, g, or t
  misc_feature (79)..(79): n is a, c, g, or t
  misc_feature (186)..(186): n is a, c, g, or t
aacgaagtacctcgcaccacctggtcctggactcctcaggactccgcggcggtggcgcgggcggtgcgcnaanggactntcactctggactctttcgtgtgcgctccagcaggggccagggacgcagggttcttcacaggttttttacaaagagaagttcggggcagggtgggagacacggatagngagatgtaatgcgaggctaaggttactgccgcggggatgtcgggcgttttagtgagggccagctccaaggagggctcagggaagagagaagcatcactgagattttgcatctgatctcgcattgcgtctgaaaagaaat

SEQ ID NO: 10024 - DNA, 298 bp, Rattus norvegicus
tgtgagcacggcaacctccaacatgtgttttccaggctactggggaagccagagagtttaggatggctgtttgtacatctgtccctcctcccctgctgtgccccagaagctctaggcctgaggagcaggaaggcaggtggggtgctcatcccgctggggaagctagcacaaggcctgaccaggtcctggactcctcaaggcagcatttcacccctacatgacaatagctgcattactgccaaccgatggtacgaccctgtgcacctttgaagagattctggttttaaattgctgcttt

SEQ ID NO: 10025 - DNA, 322 bp, Rattus norvegicus
aaatatttgtgttcacctcctctgacacacaatctgtgtagctccacagtttgaagtgttttaatcctttctcctgaagactttccaactgaccttgacagtataagatggcccaaaatttgacctcaactgagcaggagataatggagctcttaatgatattacaagagttctccgtgaaaaagatagacaaactggatgtccaggaagtaaaaaggctctttagagaggaacttccaaattttctaaaggcaatggatgaagctactaaaaacaaaatactgaatgacaaggggaaggagatgccctttgatgagatttg

SEQ ID NO: 10026 - DNA, 508 bp, Rattus norvegicus
acaagtacagtgatgacccatatctcagcaacataaaaaatcagtcattcaccatgatcacatggggatttggtgaaattgaagtggttaaaaccaaatgtagaaggattgagattgacttctacaaatgtaatttcgagagggaatcctattacgtaagacggactcctggagtaacaatatactatataacattgcctggaagtgtcagatgcaggaagctcctatctaaactggtcaactgtcccttcgaagaacaaacagaacagctgaagagagaaatatgctactttgaactgtatcctgattatattgagcaaaatatacatcatgtaagattcaattgttataccaaatgagactctaagactgactgggctgttacccaccacttgcagacattaatcctagttctggaaatctaatatggaatcacacttcagtatggatgccaggagtcacagagacatgtagtccagttatgtacacgtgaataattgtcttgctt

SEQ ID NO: 10027 - DNA, 186 bp, Rattus norvegicus
atatcttcaaatttctttacaacaagttcagtcatgacacatatctcagcaacataaaaaatcagtcattcaccatgaacacatggggatttggtgaaattgaagtggttaaaaccaaatgtagaaagattgactctgacttctacaaatgttctttccagtgggaattctgtaacataaagcgga

SEQ ID NO: 10028 - DNA, 299 bp, Rattus norvegicus
  misc_feature (70)..(70): n is a, c, g, or t
gactacatcccagtcttcatgaggaaccacacccgacaacgtgcgtatgaccacaacaatgacctgatgntgctccacctcagcaagcctgctgacatcacaggtggtgtgaaggtcatcgatctgcccactgaggagcccaaagtggggagcatctgccttgcctcaggctggggcatgaccaacccctctgagatgaaattaagtcatgatctccagtgtgtgaacatccaccttctgtctaatgagaagtgcatcgaaacctacaaaaacattgagacagatgtcacgctgtgtgc

SEQ ID NO: 10029 - DNA, 544 bp, Rattus norvegicus
  misc_feature (451)..(451): n is a, c, g, or t
ggcagacgaaatccctagaatcccaggccaaatccttcggacaagtaaagtcccaaagtggccaaatgaaatcctcctatggtcagagaaaatcctatggtgaagagactcaactgaagtctttcgaccaagatgcccaactaaaatcctatggtcaacaaaaatcccaaaaacaatcctcctttagccaagtaaaatctcaaagtgcccaactaaagtcctttggccaacaaaaatccctcaaagggttttctcaacaaactcaacagaaaggatttgccatggatgaagatttgtcacaagtgcggaaacaatttgacgatgatgacctctctgtacaacagaagtctacccaacagatgaaaacagaggaagacttatcccaatttggacaacaacgacaatttggacaagaacgctcccaatcctataaaggatatcttgcacaatncagaaagaaattacaggaacaacaacaacagaaaaattttaatcaggataacttttttacaaagggaggggcaggcctatatcaggctcaact

SEQ ID NO: 10030 - DNA, 476 bp, Rattus norvegicus
  misc_feature (151)..(151): n is a, c, g, or t
  misc_feature (201)..(201): n is a, c, g, or t
  misc_feature (231)..(231): n is a, c, g, or t
gttactaccatcagctgaggcggcacgtgtctgtggacgtgtttggccgggcgggacccggacaaccagtgccagccgtcgggttgctgcacacggtggcccgctacaagttttacctggcgtttgagaactcacagcacgtggattacancactgagaagctgtggcggaatgccttcctggctggggccgtgccagtgntacttggtcccgatcgtgccaactatgagngcttcgtgcctcgtggttccttcatccatgtggatgatttccctagtgctgcctccctggctgcctacctgctctttctcgaccgaaacgtggctgtctatcgccgctacttccactggcgtcggagctatgcggtgcacatcacttctttctgggatgagccatggtgccagacatgcagggccgtccagacctctggggaccagcccaagagtatccacaacttggcagactggttccagcga

SEQ ID NO: 10031 - DNA, 545 bp, Rattus norvegicus
  misc_feature (50)..(50): n is a, c, g, or t
  misc_feature (59)..(59): n is a, c, g, or t
  misc_feature (203)..(203): n is a, c, g, or t
  misc_feature (311)..(311): n is a, c, g, or t
  misc_feature (366)..(366): n is a, c, g, or t
ctggctatagcacgcagcttttctgcagcgtccgagcgtcacctaagccnaagatcatntggatgaaaaacaagatgagtatccagggggaccccaagtatcgtgctgtctccgagcaaggggtctgcaccctggagatccggaagcccagcccttttgattctggggtctacacttgcaaggccatcaacgtgctaggagangcctgccgtggattgtcggttggaggttaaagcctctgccacacactgaagaccaacacaggcagagactgggacaaggagacagcttggtcacataccaggatcgcngacggacattctctgccaggtcctgcagacctgaggatcaggcgcccaggcatcnccaagaccaagataccacaagaacagctaatgggggtgaacctccagaacctgctggctctctccaccagaggttgggtccagacccaggagtgggcctggcgggccccaggtcatacctcctgggtatgagagggccccaagggtgcagagactggcacccctctgcagaattgtaca

SEQ ID NO: 10032 - DNA, 457 bp, Rattus norvegicus
  misc_feature (359)..(359): n is a, c, g, or t
tgacgcttagacacaacgcactgttccttctttaatcactctgcattgaccatgcaaggaaacaagacagcttttaaacacagatcaagtctaagtattttgccccacgttgatgttttcttaaaatcagccaaggacagctgttattctgtgtactagtcataactacacattttatatactcatgtatctagcttcttttgtagtgttttcataacttaatggctgaaatattacattgagtaaatgtaggattgcggtatttttctatttatatccttaactttatgtgtacagacaggcatatactccaaggactaagaaaatgtttaagcaggtaacgtttctttttttttggnaaaaaaaaatgtttcaagtattgtaacaggaaaaatacttggtataatagcttggctatgtcagcaataaaatgactagtgactgagtacctatttat

SEQ ID NO: 10033 - DNA, 266 bp, Rattus norvegicus
agctcccagagtcagttcgttgtgttcaggacaaaccaagctactttgcttataaattatacagggcaatccataattttgcttcagggcactataagaaagcattgcttgccatctgcgccggtgatgtggaagactattaaaaagagggagggtttgaagataatggaatcttctttatagacaccagatatagacggctgaacgtgtgctgtcattgacactgaaacaaaaccataaaatcatatcttcttatatctctacaa

SEQ ID NO: 10034 - DNA, 420 bp, Rattus norvegicus
  misc_feature (97)..(97): n is a, c, g, or t
gtgctcaagccgtttgctttctaaacgtttcattactactttgaatgcggacagttacgggccagacaaggaaggacacaggcccggaagccaatcncaggtctcagcgagctcctgcccccagtctgggagagttgtgttcagcgtggccgaagcttctggtctttctcggacctccgcagtgccccggcgctccacgcgcattcacgtcccgctccttgcccacacttttccccggcctccagccggccttctgggcccggacaccggcaggcacacactcgtttctgcgccttggggacccggccgccaggtgcaggtccctaccaccctgccctgcagaatcgtctctagcagatcagctgacacctggtacccgatgtcgctgaggcttctaacccctctcttgcaaagacggtg

SEQ ID NO: 10035 - DNA, 579 bp, Rattus norvegicus
tgtgccagattgctgatgtcctcatccgcaagacacgccgcctctccgctttccagcagggattcttcaggaacaggatcctggtgatcgccatcgtgtttcaggtctgcattggctgcttcctgtgctactgcccagggatgcccaacatcttcaacttcatgcccatccggttccagtggtggctggtccccatgccctttggccttctcatctttgtctatgatgagatccggaaacttggagttcgctgttgcccagggagctggtgggaccaggaactctactattagaggggtaatcacctctccatccactatcagctgggacaaaacatcgtgtaatctgtccccagccctatggaactgtgcccacttctgcagcccatgacaccattggagggactctaccctttacccctttcactccatagtcccacacccaggaaagtactgggatgggaggggctaaacagcggttggcagctcctgtggaggtgtgtccatctcaaggactccatctggacaagagggttgtgtggggctctgttacaaattcctcatgttctgctggacagta

SEQ ID NO: 10036 - DNA, 568 bp, Rattus norvegicus
taacgtgtggccctgatcatgaagtgccaccaactttaactgactatcctaccccggtccccacttcaatatctaatatcacagtcatatacaccataaacaaccagctgaggggggttgatctgcttttcaatgtgaccatcgaggttagtgtgaaaagtggatctgtgctccttgctgtcctggaagaagcgcagcgcagaaaccacatgttcaaatttgaaaccacaatgacatcctggggccttattgtctcttctatcaacaatatcgctgagaatgttaagcacaagacctattgggagttccttagtggcaaaacgcctttgggtgaaggggttgcatactatattcccttcaactacgagcacatcacagccaacttcacccaatactgagaaggagtatcttctgttgtatgtgaccaaaggatggtttggtttcttttcatatcgtttcaaatctgtaccaagaaaagcagatattaacagtgctactccattcctgagccacggtgtggaataaatgatgcaggttcctgaggtgctcaccactgtgactcatgaaa

SEQ ID NO: 10037 - DNA, 457 bp, Rattus norvegicus
  misc_feature (149)..(149): n is a, c, g, or t
  misc_feature (365)..(365): n is a, c, g, or t
tggtggcggcaaagttcctcaacgtccccaaaaacacgcaagtcctcatcgtgtgcaagatcatggcggaccacgtgaccttcgacaacccccacgacccctatgaagggaaggtggagttcaagctcacaatacagaagtaaggagtnggcgtggctgtccaccccagagcctggtggaccctgagggaccactcttcctgactgacatcatcggctggccagcatgcacggccacttcatggttcagagctgacaccactgcccatctgccgacagcaggaagtgctccttcccagcactccctgagcaccaccagctttgaactgaaacccgacgtgcgcacgcacgtttgcaatcccgtgnggttaacacaggaacccagagtccggctaccactaagggacaacccatctgtagggcatttctatcctgtgaccatttgtctgtcctgcact

SEQ ID NO: 10038 - DNA, 458 bp, Rattus norvegicus
atggtgtcttcagcgactatctgcagtttgctactcctcagcatgctctggatggacatggccatggcaggttccagcttcttgagcccagagcaccagaaagcccagcagagaaaggaatccaagaagccaccagctaaactgcagccacgagctctggaaggctggctccacccagaggacagaggacaagcagaagaggcagaggaggagctggaaatcaggttcaatgctcccttcgatgttggcatcaagctgtcaggagctcagtaccagcagcatggccgggccctgggaaagtttcttcaggatatcctctgggaagaggtcaaagaggcgccagctaacaagtaaccactgacaggactggtccctgtactttcctcctaagcaagaactcacatccagcttctgcctcctctgcaactcccagcactctcctgctgacttacaaataa

SEQ ID NO: 10039 - DNA, 464 bp, Rattus norvegicus
gtgactctgcactgtgatgacggctccagtcggaccttcagctacacccaggttgagaagtgtggctgcctgggccagcggtgccatgctccaggtgacacaagccactcagagtcctcagaacaagagttcaagtccaaggaaagtgaggaacctggccagcagtcagcatccagggtcagcgaggacacccttgggcctttccagtaaaccaagcagcactgccgtcccaaccaagaagtcctcctgaggccagcaggacgtgtactttagtccaagtggcttgaattctacctacctgctgcttcctcttcaagagggaccccggatgttcttggaggtgggagaggcccctctccactgattaggagcgtgatggccacgggctccttttgaaagaacttcattatcaccaaagggtcccaggagtgacagtcacttggatgcaggtatcagcctcgctc

SEQ ID NO: 10040 - DNA, 512 bp, Rattus norvegicus
aagagcctagcatacagcctgtgtgtgtccagagggcaagcacttgaggaggcagggacaatatgctgtctgcagggtaaggagagaggcctcaggagaatttagcctgggacacttccacctgggacttctggccatcagcatgtgaggtaagcctcccatttcaggacttccaccttgaacttctggcctccagcatgtagtgtaagcctcccatctgaggtgctctgaattgattaacacataaaccaatggacggagtcatcagtatgacaagatcaccgagtgctcccagcccaggaatctccacgactgtgatgtggctcagcatagcgctggccatcaggtggattgggtctgggagtcagaggcagggcagaaagttctggaaacagagagcagcctgaacatgttcatgtagctacagaccactaaaaattgtggccagagcaaattttgatacatagtatatgtgacctcaaaggctggctgccttagactctgtcaatgca

SEQ ID NO: 10041 - DNA, 574 bp, Rattus norvegicus
actctgtacgtcatgttgcttctcatcgcagagtatccggaggtggaaacagctatactgaaggaaatccacactgttgttggtgacagagacataaggattggtgatgtgcaaaatttgaaagtggtggaaaacttcattaacgagagcctgcggtatcagcctgtcgtggacttggtcatgcgcagagccctggaggatgacgtgattgacggctacccggttaaaaagggaactaacatcattctgaacatcggaagaatgcacaggctcgagtatttccccaagcccaatgaatttacccttgaaaactttgagaagaacgttccctacaggtattttcagccatttggctttgggccccgcagctgtgctgggaagtacatcgccatggtgatgatgaaagttgtcctggttacacttttgaaacgattccatgtgaagacattgcaaaaaaggtgtattgaaaatatgccgaaaaataatgacttgtccttgcatctagatgaggacagccccattgtggaaataatttttcggcatattttcaatacaccttttttgcaatgcctgt

SEQ ID NO: 10042 - DNA, 575 bp, Rattus norvegicus
gggagatcacctgggttcctgtcactcaggagctctactggcagattaccattgacgacttcctcattggcgaccaggcctctggatggtgctcctcccagggctgccaaggcattgtagacacaggtacctctctgctcgtcatgcctgcccagtacctcagtgaacttctgcagaccataggagcccaggaaggagagtacggagagtattttgtgagctgcgacagtgtcagtagcctgcctaccctcagtttcgtcctcaatggtgtccagttccccctgtcaccctcttcctacatcatccaggaggacaacttctgcatggtgggtcttgagagcatctctctgacctctgagagtggccagcccctctggatccttggggatgtcttcctcaggtcttactatgccatcttcgacatgggcaacaacaaggtgggccttgccacttctgtctagacttgccctctagacacgcctgtgcccttcttcccctcagcctgcctgccccctctgttcctcctctctgcatccagcttgtcttttccggaccctagacttgccctaataata

SEQ ID NO: 10043 - DNA, 314 bp, Rattus norvegicus
agaagagggccgtctgtaatttccagatcaatgttgaaccttggctgaacaagatatccctgacaaacttcaaatgttacaatgtctgaggatctatgtcaggctacacttctgttgaataccccttactcttactcaatcatctccttaagttttcctttacttagacagagagcatagccctgaagaatgaatcgtcaaagttctagtaccaagagaaaagtagaaataggctctgcacacctaagtggtgattccctttttcctttcttctacttgattttcacatgtaccactgtggagtctattgctca

SEQ ID NO: 10044 - DNA, 544 bp, Rattus norvegicus
  misc_feature (273)..(273): n is a, c, g, or t
  misc_feature (491)..(491): n is a, c, g, or t
tgaaactgcccctggtttttgaaatttctttttctctgcctgtcattggccctacgctcgacgttgctgtttccttggacctcctaaactcagtcagtgttcaaaccaatgcccagactggcctccctggggtgaccctaggaaaatgctccggtaatacagacaaaatctccatttccttgttgggcagacgacttcccttcgtcaaccgtattctggatggtgtatctggcctcctcacaggtgcagtgtcaatcctgctgcaaaacatcntatgcccagtgctccagtacctcctcagcacaatgagtggaagtgctattcagggtctcctctctaatgtactaacaggacagctagcagtccctctctgaagaggaagaacagaaggaggaagccatgacaacccctgctggttagtctccactggctttattttacttccggtggcatttctttctgggaagttctactatcatccacacaaagtntacctgataccaacggaaggactttcccagattcccttctttcctgagtagtc

SEQ ID NO: 10045 - DNA, 409 bp, Rattus norvegicus
  misc_feature (121)..(121): n is a, c, g, or t
aacttcttgaatatgtggcccgtaaggctcctgaaatggcatcccaggtggctgcctgcatgacaggcatgatcaacggggacacaaccattcgccagtttatccaggacctgggaggatngggaaacctggagggctgaagaagagggttctccccggactgagcatacttcttctggcagatcgggtggctgttttctgacaattaaaacatgctgttttcaagtccgccagtgtcctttctattgatcattgactttggaagcagcttccaggagcctacagtgacattatactttctcgcctcatgtgagttttagtaagagtttgtcgaaacaaagacctcctgagaaagtaatttcttagtagtaaaatttcaagcaccaggtccgatctttgctggagatat

SEQ ID NO: 10046 - DNA, 416 bp, Rattus norvegicus
ttcataaatctatacccgtgtgtgtatacatatatatatatatatatatatatatatatatatatatatataaatttagtgcatctctctgtatgtacagagtatatgtatagtatggatatggaaattatagagaatacacatacctatatgtgtatatattgcatatgacctaaaaatcacttatcactgtggtttgaagctgtaatctcatctacaggttcatgtctctggacgctcagttccaaggagagtcatgctcttttgagagattactgaatctttcagataagaggcctaacttgtgaaactaagtcactttgtttgctttgaaggttacactgccttgcagttgaatgttcacattacctttctggttaaaagcaatatctaaagactctgctatcagcctaaat

SEQ ID NO: 10047 - DNA, 368 bp, Rattus norvegicus
  misc_feature (90)..(90): n is a, c, g, or t
actgggctcccctttaatggctgggggcctcatagagacttcacatctccagatgagtcccacattcccgggcaagccacttcacctctntgagcctcagcctgccccactccaaaggccatcataaggtattccctgcccactcagggtttttgtgaagacaatacatgtagaagtttggtgtcaatgcctggtaaacttgagagataggccaagtatttcccatgatgatcagcattctccactctctgttgacttgtgtgggttgttccagcagacctctgacccagcttctggtcatgtgtgttcaacgggagcctcagtagatggagagagggagaaggaacatgtgttctgtaggcagtcac

SEQ ID NO: 10048 - DNA, 472 bp, Rattus norvegicus
  misc_feature (181)..(181): n is a, c, g, or t
tcttcactgtcctgctatttgccagccttgctgccacctctcttgctgccgtgcctgggtccaaagatgaactccacctgaggactcagcccacagatgccattccagcttcccagttcactccttccagccacatcagcaaggagagcacttccagtaaggacctttccaaggagtcttncatcttcaacgaagagctggtgtccgaagataatgtggggacagaatctaccaaaccacagagtcaagaggcccaggacgggctcaggagtgggtcatctcagcaggaagagaccacctcagctgcaacctcagagggaaaactgaccatgctgagccaggcagtgcagaaagaactgggtaaagtaattgaaggatttataagtggtgtggaagacataatctctggtgccagtggtaccgtgaggccctgaagacaaaaacgcctaaccgctaagtcccacgctaggtg

SEQ ID NO: 10049 - DNA, 252 bp, Rattus norvegicus
attacacagcccgttctgcagggaagtggcctctgaagtggtacgcaccagaatgcatcaacttccggaagttctccagccgcagtgatgtctggagctatggggtcaccatgtgggaggccttctcctatggccagaagccctacaagaagatgaagggccctgaggtcctggatttcatcaagcagggtaagaggatggaatgccctccagagtgtccgcccgaaatgtacgcgcttatgagtgactgct

SEQ ID NO: 10050 - DNA, 497 bp, Rattus norvegicus
  misc_feature (305)..(305): n is a, c, g, or t
atccagcttttattacttcttccaaattccacggctcccagaacttatgttctcaatcaatgatttcaaggctttgaaacacctgtttaccagtcagagcactggcatcggaagaaaaggacgtcagctgacaacagaagatctagaagcttatgtttatgttttctctcagcccggagcactaagtggtccaattaaccattatcgaaacattttcagctgcctgcctctcaagcatcacatggtgacaacaccgacgctgcttctgtggggagaggaagatgcgtttatggaggtggagatgnccgaggtcacaaagatttatgttaaaaactacttcagactcaccattctgtcagaaggtagccactggcttcagcaagaccagcctgacatagtgaacgggctgatatgggcattcctgagggaagagacaaggagagactgactttatctcctacagggagtctttcacggagtctctgaaacctcttaaa

SEQ ID NO: 10051 - DNA, 302 bp, Rattus norvegicus
gtccaggctgatcccattcaagaggcagaggaagagactaaaactgaggagcagccagcagatgaggaccaggatgtgtctgtctcctttgaaggcccagaagcctctgctgttcaagatttacgcgtaagaaggaccttgcagtgcagttgcagaagagtctgcagaaatacgtgtagctgcattcggctatcaaggtccacatatgcatcataaattctgctgcagctgaacatggaccccaaggatgagataaccacatgccctggggcctcacagtcggtcattacccttgtgcttgg

SEQ ID NO: 10052 - DNA, 226 bp, Rattus norvegicus
cctagatattgattttgccacccgcaagattgcagtgcgtctgactcagacgaagatcatcgttcaagacggtgataacttcaagacaaaaaccaacagcacgttccgcaactatgacctagatttcacagtgggggtggagtttgacgaacacacaaagggtctggatggccggaacgtcaaggagctgacctgcggtgaccaggtgtgtcgacaagtgttcaaa

SEQ ID NO: 10053 - DNA, 391 bp, Rattus norvegicus
gaacactccgtatcagcaatgctaatttggtttatggaggccgtaaacatcagcctccttttactcaagaggaagctaaggagacactaatatttgacctgaaaaatatgaatgttactcttgatgaaccaatacaaatcacctggtcatgaagatcaacatcagtttgagttcctgaggaggaattgatatcaggtccatggttctatttccatttttcctgactgcatacgttctttgaaacacaattatcatgctccttatccaaatatttctccattgtttgcatcaaaagaaatgctagcttgtgctacaaatgcatcctggatgccactgctcagcagggtgaaaaggatttgaatggttatgataccttgcaagtcacagctaa

SEQ ID NO: 10054 - DNA, 484 bp, Rattus norvegicus
  misc_feature (438)..(438): n is a, c, g, or t
agtacatatagacgtctccagccagatctcctcagcaagggacagaggccactcacctggggtcccagcaggagttcacagcacaagcaggatgaagtcttccattgccatcgttttttgcctcttgatcctgggagttgacagcaaaagacggttccagtttatgaaggaagctgggcaagggaccaaagacatgtggcgcgcctactcggacatgagaaaggccaactggaaaaactcagacaaatacttccatgctcgggggaactatgatgccgcccgaaggggtcctgggggagcctgggctgctaaagtcatcagtgatgccagagagggtattcagagattaacaggacacggagcagaggactcaagagctgaccagtttgccaacaagtggggccggagtggcaaagaccccaaccactttcgacctgntggtctgcccaggaaatactgaattttctcttcatgttgttcccgg

SEQ ID NO: 10055 - DNA, 494 bp, Rattus norvegicus
  misc_feature (56)..(56): n is a, c, g, or t
  misc_feature (119)..(119): n is a, c, g, or t
  misc_feature (125)..(125): n is a, c, g, or t
  misc_feature (412)..(412): n is a, c, g, or t
tgatagggcctcactccaaggagacaggcaagagacagaaacatctcccagctttntcaggaggactgtggggacccaggtaccttcacatgagaataaggaggcttggactagctctntcttcngtgggaacgttcaagtctttgacatgttagttggtaggaaaagcagggaggaaaaacatgagcacaggtagtagagagagaccaaggaagctatgctgggaggctgagggagggagaaggtagcaggtagcatcttctcccttgatgaagtccctcctcaggcagcaaatgggtgctctcgggcgccgccatcaccaagacatagatcccgagaaacccataaaagcaggagtcagtgttgaagccactgtgacagcacaggcattctgtctaggactctgtcagangggccgggtgttgtccactcaatgacgcttcactgggcctcagcctgctccataatggaagcttagcagtggccaccaacat

SEQ ID NO: 10056 - DNA, 595 bp, Canis familiaris
  misc_feature (26)..(26): n is a, c, g, or t
tctgtggtgcttctctcatcagcaangactggctggtgtctgctgcccactgtgtgtatggtccattgtcaaagggtgccaccctgagatgcttctttcccctaagattgatgtctaaaaaatgttcaggctgcataaaacaaaaatacatttttttagataaaatgttgaaaataattgattttcttgttagaaatgcatgtttactgtgttttgtttttccagattatatacaacctatttgtttaccagaagaaaatcaagtttttccccccggaagtctttgttccattgctggctgggggagggttatatatcaaggtcctactgcaaacatattgcaagaagccaatgttcctcttctatcaaatgagaaatgccaacaacagatgccagaatataacattacagaaaatatggtatgtgcaggctatgaagaaggaggaatagattcttgtcagggggattcaggaggaccattaatgtgccaagaaaacaacaggtggttcctggctggtgtgacatcatttggataccagtgtgcactgcctaatcgtccaggggtgtatgcccgggtccggaggttcacagaatg

SEQ ID NO: 10057 - DNA, 220 bp, Canis familiaris
atgagtgtaaaaaagtctcccgaagaactgaagagcatttttgaaaaatacgcagccaaagaaggtgacccagaccagctgtcaaaggcggagctgaagctactgattgaggcagaatttcctactttactgaaaggtcccagcaccctagatgacctctttcaagaactggacaagaatggagatggagaagttagtttcgaagaattccaggtgttag

SEQ ID NO: 10058 - DNA, 520 bp, Canis familiaris
agcaggcagcggtgtttaagttcccgctggcaccgctcggctgctccgggctgggctctgcgttgctggcagcggggcctggactgcccggtgcccccagcgcaccgcacctgccgcttgagctgcagctccgggggaagttggagacaccgggccccggagagccgggtgccaaagccaagaaggggcgtcggagccgcaccgtgttcactgagctccagctgatgggcctagagaaacgctttgagaagcagaaatacctctccacgcccgacagaatagatctcgcggaatccctgggtctgagccagttgcaggtgaagacgtggtaccagaatcgcaggatgaagtggaagaaaatagtgctgcagggcggcggcctggagtctcccaccaagcccaaggggcggcccaagaagaattccattcccacgagcgagcagctcacggagcaggagcgcgccaaggaggcggagaagccggcggaggcgcccggcgacaccatcgacaggagccgaga

SEQ ID NO: 10059 - DNA, 154 bp, Canis familiaris
aaagagagccaagactaagttacctcaagactatgtattcttcccccttttggagtcagatttttccatttctacagtgttgtcatcatcaccatcttcatcatcattatcatcatgttcttaataagtacatctaataaggtccttctgtagc

SEQ ID NO: 10060 - DNA, 203 bp, Canis familiaris
gtgaatttatcagttgggtggcattggatcacgagcatcaggtacaccatcaggtgactgtcctagtgactgatcatggctccccaccacgaaatgccaccatggtggtttatgtctcagttactgacatcaatgataacaggccgtatttcccacagtgtctccctgggaaggaattacacatcaaggttctggaaggccaa

SEQ ID NO: 10061 - DNA, 309 bp, Canis familiaris
tgctttccaagctgctaggagagagggaagatgtggttcatgtgcataagtataatcctacagaaaaggcagagtcagagtcagacctggtagctgagattgcaaatgtagtccagaagaaggatgttggtcctcctgatgccagagggagtgcagagcgtgaggacaggggcaatgccgttcttgttcgagacagaattcacaaattccacaggctagagtctactctgaggccagcagagagcagagttctgtcattacagcagcccctgcctgctgaaggcacctgggaaccagaccgctcaggag

SEQ ID NO: 10062 - DNA, 482 bp, Canis familiaris
cacaactccttgtgcttttagttttataaaggattatactgttttttagagttttcacctagctggttatattcaacctaaaattatgaaattctctgctcatatctttgtcattttgggtgccatttttgtgtatagtagtaatgcatatctggcttactaaattgggcattagtgggttaccagagttatgtgttatagttctcttattcactcatcttattttatgattactacatgccaggttagaagtggaactatagagtattatggaagtgaatgtcatattgccatgagtaacaaaatgtgttcccggcagcacccattgtactaagaagtcgtgaactgacggaagatatggggtctactcaactctttaataaccatataagtgatataatgaactaactgtgccacatattgaaattgaaatgggggtcccttggagtaacttctttgtttcctgttttcagaaggtcaga

SEQ ID NO: 10063 - DNA, 449 bp, Canis familiaris
  misc_feature (170)..(170): n is a, c, g, or t
gaaaacgctgcatgcggcacgcgatgtgctgccccgggaattactgcaaaaacggaatatgcatgccttcggaccacggtcacttccatcgaggagagatcgaggagaccattctggagagcggtggcaacgaccacagcaccctggatgggtaccccagaagaaccacnttgtcttcgaaactgtatcataccaaaggacaagaaggctcggtctgtctccgatcatcagactgcgccacggggttgtgttgcgcgcgacacttctggtccaagatctgtaaacctgtcctcaaagagggccaggtgtgcaccaagcacaggaggaaaggctcccacgggctggagatattccagcgctgttactgcggcgagggcctgtcttgccggctgcagaaggatcaccatcaagccagtaactcttctaggctccacacctgtcagagacat

SEQ ID NO: 10064 - DNA, 576 bp, Canis familiaris
  misc_feature (158)..(158): n is a, c, g, or t
aggacaggcccctataaggccgtggcctttggcctgatcccctgcagtgacctgcccagcttggacgccgtgggggacgtggcccgggcctcggaaatcctgaacgcgtacctcgtcagggtgggagccaacgggacctgcctgtcagaccccaactntgggggtctctgcaacgcgcccctgtcagcagccacggagtacaggttcaagtacgtccttgtcaatatgtccacgggcttggtgcaggaccagaccctgtggtccgaccccatccgcaccaaccggcccaccccgtatgcggcgatcgacacgtggccgggccggcggagcgggggcatgatcgtcatcacgtccatcctgggctccctgcccttcttcctgctggttgcctttgccggcgccgttgtcctcagccttttggacatgggcagctctgaccaggaaacgaggacgcacgactcccagatcacgcaggaggccgtcccccggtccctggggacctcggaggctgtgtacacgtctgtaaaccgggggccaccgctggacagggctgaggtgtacaccagcaagctgcag

SEQ ID NO: 10065 - DNA, 490 bp, Canis familiaris
  misc_feature (35)..(35): n is a, c, g, or t
  misc_feature (125)..(125): n is a, c, g, or t
agatttccagtcatttcttccaaaacactgtaatngcatgctaacatttcatgaagtcatgtttctcttctgggaaatgtgtattttcatttaacctttggatttactaatactataatactatngtatattcatggtgtgaattcctttaaagatagtattgttcttggacctgtatccattttaccttgtatatgcttgactccagttcagcatccagtagttgttgaaaggatgagcaaaatacattatctatgtaacaaaacagtaagtatacagaaagtaaaatatgttaacttgttctttgttttatgtaattaaattgtcattaatagtctaatggttgtagctgtatagtgacctttttaaaaaaatatatatatattcatatatacccaaattaatttttttaaatgcctttgttgtggtagaccataatgatttcaacaactgtgcaacaaggtttggatgctcctcttttgagatttgt

SEQ ID NO: 10066 - DNA, 520 bp, Canis familiaris
  misc_feature (31)..(31): n is a, c, g, or t
  misc_feature (44)..(44): n is a, c, g, or t
  misc_feature (46)..(47): n is a, c, g, or t
  misc_feature (450)..(451): n is a, c, g, or t
  misc_feature (453)..(456): n is a, c, g, or t
  misc_feature (458)..(458): n is a, c, g, or t
  misc_feature (460)..(460): n is a, c, g, or t
  misc_feature (484)..(484): n is a, c, g, or t
  misc_feature (487)..(488): n is a, c, g, or t
  misc_feature (490)..(493): n is a, c, g, or t
  misc_feature (495)..(495): n is a, c, g, or t
tctgggtatctggtgaagatcattttaggtnactgaccaagggnannaaatgccccagtgatactggacccacagccatattgccagcaccatgtctactatacaaagaaaaggcagcagccacctgtttgacagtttgtccacctgtaaactgaagtttccagaagaccagcgacagcaagaaaaatctgtcattgctcaaccaatatttgtttttgcaaagagagaacaaacttttaagagacctgcagaggactccacctatgaagcatcagaacatgaatgcaatggttttctgagaaagcgcgtaaggtcttcatcttttactttgcacactacacatcctcagtccccaggagcatcaagcttgtcccagaatcgaataagatcatcatccttcaccaacctcctgaccttccccccttctgggccagggtgcctggtggctcnntnnnngngnatctgctttcagctcagctcgtgntcnngnnnncntgggatcgagttccccatctggctc

SEQ ID NO: 10067 - DNA, 548 bp, Canis familiaris
  misc_feature (69)..(69): n is a, c, g, or t
  misc_feature (378)..(379): n is a, c, g, or t
  misc_feature (422)..(422): n is a, c, g, or t
  misc_feature (429)..(429): n is a, c, g, or t
gacatttgctcactaatcaggctcaaactatttttcttttgctgtgacacattcatactccatgtaacntaggtatttccaggtttagtccctatttctctaactctttgtaaaaaatgtgttttatattacatgttctcaccaaccatgttgaaagaatcgtgtaaaaatcttaatgtacaaattgtatagctttgcagatataggtcttaagacttgcttttcagtgtgttgatacattcccaaggttacttaattcaactaaacaagcattttgttcagcaccaagccatgccccaggcacggtgcaaaattacagacagcaaaggggagaaaaagagactaatgtttctgatctgatatcccagaatactaacnnaactgttgccgttaagactcccacatatgtgagctggcttttnccccccnttttcatcctttgtcactgttcttatactccatcatcattattcagcaggcctcaataaaggtttacaaacaagacttctgccagggaaagccaggacatctagtttctcttaggcatc

SEQ ID NO: 10068 - DNA, 482 bp, Canis familiaris
gggctgctctgctccacgagatcacgccaccgcacgttcgaggggacctggctgtcaacgcactcagcaacaatacaacagctggccaggctgtcaccgtggagcttttcctgaccctgcagttggtgctctgcatcttcgcttccacggatgaacggcgtggagacaacctgggcacccctgccctctccatcggtttctctgtggccctgggccacctccttgggatccactacaccggctgctccatgaatccggcccgctccctggctcctgctgttgtcaccggcaagtttgacgaccactgggtcttctggatcggacccctggtgggcgccatcctgggctccctcctctacaactacgtgctgttcccgcccgccaagagcctggccgagcgcctggcggtgctcaaggggctggagcccgacgccgactgggaggagcgcgaggtgcgccggcgacagtcagtggagctgcac

SEQ ID NO: 10069 - DNA, 545 bp, Canis familiaris
aagtgcccttgcttctgagagccatccctgttggaatcggccaggtgtacggctgcgacaacccctggactggaggcatcttcctcatagctctgttcatatcatcacctcttatttgcttgcacgctgcgattggctccaccatggggatgttagcagccctcactatagcaacgcccttggagtccatctacttcggcctgtgtggcttcaacagcacactggcctgcatcgcgataggaggcatgttctacgtcctcacctggcagacccacctcctggccgttgcctgcgcgctgttcgcggcctacctgggcgctgctctggctaatgtgctgtccgtgtttggactaccaccgtgcacctggcccttctgcctctcagcactcaccttcctgctcctgacgaccaacaaccccgccatctacaagcttccactcagcaaagtcacctacccagaggccaaccgcatctactacctatcccaggagaaaaacagaagagcatcaaccataacaaagtaccaggcctatgatgtctcctag

SEQ ID NO: 10070 - DNA, 495 bp, Canis familiaris
gaggctctgtcacctatcagtgtggtggcagcctcattagtccttgctgggtggtcagcgccacacactgcttcattaattcccagaagaaggatgactacattgtctacctgggtcggtcaaagcgtatctccaaaacatttggggagatgaagtttgaggtggaaaagctcatcttgcatgaggactatagtgctgacagtcttgctcaccacaatgatattgccttgctgaagatccgttctgatgagggccagtgtgcacagccatccaggtccatacaaaccatctgcctccctccatcacgtggtgatgctcattttggtgcaagctgtgagatcagtggctttggaaaagagaattccactgactatctctatccagagcagctgaaaatgactgttgtgaagctggtttcccaccaggagtgtcagcagccccactactatggctctgaagtcaccgaccaaatgctgtgtgctgctgacccagagt

SEQ ID NO: 10071 - DNA, 563 bp, Canis familiaris
  misc_feature (416)..(416): n is a, c, g, or t
aagatcacctgcctggtagtggacctggccaccatggaaggcatgaacctgacctggtaccgggagagcaaagaacccgtgaacccgggccctttgaacaagaaggatcacttcaatgggacgatcacagtcacgtctaccctgccagtgaacaccaatgactggatcgagggcgagacctactattgcagggtgacccacccgcacctgcccaaggacatcgtgcgctccattgccaaggcccctggcaagcgtgcccccccggatgtgtacttgttcctgccaccggaggaggagcaggggaccaaggacagagtcaccctcacgtgcctgatccagaacttcttccccgcggacatttcagtgcaatggctgcgaaacgacagccccatccagacagaccagtacaccaccanggggccccacaaggtctcgggctccaggcctgccttcttcatcttcagccgcctggaggttagccgggtggactgggagcagaaaaacaaattcacctgccaagtggtgcatgaggcgctgtccggctctaggatcctccagaaatg

SEQ ID NO: 10072 - DNA, 492 bp, Canis familiaris
gctacagaacaaggccggcttataggaacctcccgcttatttggaaaggaaaatgtcttgtgcaagcaacaaagtggactccttgctccagaacgtgtgggatgggaatatctgatcgggtcaccaatgaaaatagcaactgtgaaatgagaagagagagaagactgtgttatattcaaccttgtgacagtaatatattaaagagagtaaagatcccgaaaggaaaaacgtgccaacctactttccaactcttcaaagctgagaaattcgtcttttctggatgctcaagcactcagagttataaacccactttttgtggagtatgtgtagataagagatgctgtgttcctaataagtcgaaaatgatcaccattcaatttgattgcccaaatgaaggctcatttacatggaagatgctgtggattacatcttgtgtatgtcagagaaactgcagagatccaggagatatattttctgagctcgagatcctat

SEQ ID NO: 10073 - DNA, 287 bp, Canis familiaris
gaatgtgaaagaaaccctaatcttaagagaagggacccacaaaatcatcaccaaccaatatgggaagaaacaaaaatatgatttcattatataacattcaactgagcatttctcagatacactaaaactttgtggtaagattatacttttgtttttgaaccaaagcacggaaatctaacctgacaatctataacaatattgttaatacccccacatttttgcccatcaggctgtaagtgttagcatcaaaatatagtatgtcccttacccctgtcttttgaaagcat

SEQ ID NO: 10074 - DNA, 560 bp, Canis familiaris
atgacccaagttctcctgtggctgggccttgccttgctggggtccttgcaggtccagacccaggactccaccccaagtctgatcccagccccgcctccgctcaaggtgccactgcagcctgacttccagcatgaccagttccaggggaaatggtacgtcatcggcatagcagggaatatattaaagaaagaaggacatggccagcttaagatgtataccaccacctatgagctgaaagatgaccagagctacaatgtcacctccaccctactcaggaatgagcgctgtgactactggaacagagattttgtcccaagtttccagcctggccagttcagcctgggcgacattcagctttaccctggagtacagagctacctggtgcaagtggtggccaccaactacaaccagtatgccttggtgtacttccggaaagtctacaaaagccaggagtacttcaagatcaccctctatgggaggacgaaggagctgcccctggaactgaagaaggaattcatcaggtttgccaaatccataggcctcacggaagaccacatcat

SEQ ID NO: 10075 - DNA, 491 bp, Canis familiaris
  misc_feature (455)..(455): n is a, c, g, or t
aaggcccggccctgtagagtaagcactgctgaccggagtgtgcggaagggcatcatcgcacacagtctcaaggacctcctgaacaaggtccgggacaccctgctgctggcagacaagcccttctacctggtgctggaggaagacggtacaactgtagaaacagaagagtatttccaagccctggcagatgacacagtgttcatggtcctccagaaggggcagaaatggcagcccccccaagaacagggttctaggtaccaactgtccctctcccataagcctgccaagaagattgatgtggctcaagtaacctttgacctatacaagatgaacccacaggacttcattggttgcctgaatgtgaaggccactctttatggcacatactccctttcctatgacctgcattgctacggggccaagcgcatcatgaaggaagttcttcgttgggcccntcttcagcatgaagaccacaggccatgtgctgctcg

SEQ ID NO: 10076 - DNA, 501 bp, Canis familiaris
  misc_feature (132)..(132): n is a, c, g, or t
  misc_feature (237)..(237): n is a, c, g, or t
  misc_feature (242)..(242): n is a, c, g, or t
  misc_feature (249)..(250): n is a, c, g, or t
  misc_feature (252)..(252): n is a, c, g, or t
  misc_feature (254)..(261): n is a, c, g, or t
  misc_feature (263)..(264): n is a, c, g, or t
  misc_feature (266)..(276): n is a, c, g, or t
  misc_feature (278)..(278): n is a, c, g, or t
agtggtttagtttcacaaatccttggaccaaagaactggaatatattgtgtctgtcaacactttagtttttcttcaattgaatttttccttttgttgttattatttagaatcctctaaacagtcttgtattngtgtgcctggaatgtctgctggaatagtacttggtgctggtagtattggaacagatattgtaaatgaagtcctagatttacaaagtgcccccgtcagtgcccgcnacccngtcaccnncncnnnnnnnncnncnnnnnnnnnnncncccctagttcaccttaactgtttattattctgtcagacgtcaaaaaaggagttgattccactaaattcttctgaaatagggaagtcagaggctacaaggcgaaaccaaagtgctgttcctccccatagtcatgaaccactccttggcgaaaatgcccagctggattttgatgccttgtgtgacaatgacgacacagccatggctgccttcatgaactactttg

SEQ ID NO: 10077 - DNA, 43 bp, Canis familiaris
cagccagccctggaggatcatattttggaacatctgcccgcgc

SEQ ID NO: 10078 - DNA, 516 bp, Canis familiaris
  misc_feature (468)..(468): n is a, c, g, or t
caggcaggacacacgacggctgtgtgcttcagtttctccttttatttctcccgtacaaaccccgtccctcccccctgtaaacatggtgctgtgagatcgcagatggagaaggctccctcctccggtggctggatagtgagggtggcccctggctcttctctcagcgcgacccctcagtgctcggcagtcatactggggcgccggagatgtgagctgtggtcagcctccctgggctgctgggggccggtagcttcttggtctgagcttcatttccgtgaagggcacagagaactcgaaacccttccagtagtaccagctcaccccctgggaaaggattgttgagacagagtcagagccagacagacgtcccatctgctccccagcctacaccctgcaccccggcatctggggagatggttcccagaaatcaatcaccctccccccgcacccacttcatgatcctcaacngcaaaggccggaggcttagtttaagctggccctttacatccaataaat

SEQ ID NO: 10079 - DNA, 147 bp, Canis familiaris
  misc_feature (94)..(94): n is a, c, g, or t
tgatgagagggtggacactgcctctccccccttcaggccagcagggctgccggaggaagtcccgagggggtggagctggggggtgtctgctccncggtcctcggtgcccctccgctgctccctttggaccagctctcaggagacaga

SEQ ID NO: 10080 - DNA, 361 bp, Canis familiaris
  misc_feature (322)..(322): n is a, c, g, or t
tctacgagatggcacgcagcctggaggtgcaggaggtgctgcgggaggaggtcctggccgcgcggcgccaggcccagggaaacgtgagcacgatgctgcagctggtcccgctcctcaaagccagcatcaaggagacactgaggcaagcccgccggccacgcctgcccgcctcacctcccaggccccgggcaggactccaccccatctccgtgaccctgcagagataccttgaaaatgacttggttcttcgaaattacatgattcccgccaagacgttggtgcaggtgtccacctatgccatgggccaggaccccaccttctncctcaacccgagcaagtttgacccaacccgctggctggg

SEQ ID NO: 10081 - DNA, 424 bp, Canis familiaris
gaacagggatgaccactacagccctaacttccaggagatccgcatgttgaagaagactgtgtatgtctacccgggggacgtgctcatcacttcctgtacatacaacacagaagacaagaatgaggccactgtggggggcctggggacccaggaggagatgtgcgtcaactacatccactactacccgcagacacagctggagctctgcaagagccatatagacccctgcttcctgcagaagtatttccacctagtgaacaggtccaacctaggggaatactgcacctgccctcaggcttctggcaccacctgccctcaggcctctggcaccacctgcccccgggcctccgtccccgagcagtttgcttcggttccctggaactccttcagccgagtggtgctcaaggccctgtatgacttcata

SEQ ID NO: 10082 - DNA, 41 bp, Canis familiaris
tatctccactcaaagtaaggtgctcatggttctcccaaaag

SEQ ID NO: 10083 - DNA, 495 bp, Canis familiaris
  misc_feature (41)..(42): n is a, c, g, or t
  misc_feature (57)..(57): n is a, c, g, or t
  misc_feature (65)..(65): n is a, c, g, or t
  misc_feature (72)..(72): n is a, c, g, or t
  misc_feature (93)..(98): n is a, c, g, or t
  misc_feature (105)..(105): n is a, c, g, or t
  misc_feature (111)..(111): n is a, c, g, or t
  misc_feature (114)..(114): n is a, c, g, or t
  misc_feature (131)..(131): n is a, c, g, or t
  misc_feature (146)..(146): n is a, c, g, or t
  misc_feature (152)..(152): n is a, c, g, or t
  misc_feature (162)..(162): n is a, c, g, or t
  misc_feature (202)..(202): n is a, c, g, or t
  misc_feature (218)..(218): n is a, c, g, or t
  misc_feature (268)..(268): n is a, c, g, or t
  misc_feature (296)..(296): n is a, c, g, or t
  misc_feature (339)..(339): n is a, c, g, or t
  misc_feature (442)..(442): n is a, c, g, or t
aattacatgattcccgccaagacgttggtgcaggtgtccanntatgccatgggccangaccccancttcttnctcaacccgagcaagtttgannnnnnccgctgnctgggnaangacaaggagctcatccncttccggaacctggnctttgnctggggcgtncggcagtgcgtgggccggcgcatcgctgagctcgagatgnccctcttcctcatccncattctggagaacttcagagttgaaatgcagcaactcagggatgtgggcnccacgttcaacctcatcctgatgcccgncaagcccatcttcctcaccttcaggccgtttaaccaggacccnccccaggtgtgatgagagggtggacactgcctctccccccttcaggccagcagggctgccggaggaagtcccgagggggtggagctggggggtgtctgctccncggtcctcggtgcccctccgctgctccctttggaccagctctcaggagacaga

SEQ ID NO: 10084 - DNA, 557 bp, Canis familiaris
  misc_feature (226)..(226): n is a, c, g, or t
atggcgctgggctgctgtcctcctacggggagctcctgcactccctgtctgaggagcccgagatccgggccttcgacccagacgctgcggccgtgcagccttaccaggaccagacctaccagtcggtctactttgtgtctgaaagcttcagcgatgccaaggacaagctcaggaactacgcttcccgcatccaacgccccttctccgtgaagttcgacccatatangctggccatcgacgtgctggacagtccccacgccatccggcgctcgctggagggggtccaggacgagctgcacaccctcgcccatgcgctcagcgccatcggctagctgcagccggagaggcccctgcagtctcctcacccttccccggcctcccccggcccctgcccaagcaaggggctggggcactgggcacccccaagagcctgccagagaccctccccacgggaaggcaccccaccaacccccaccctgctgcttcctggctctgcctgcagtgtcctcgtcctgcccgtgatgctgtgcgctgcccactcacaatcccaataaaag

SEQ ID NO: 10085 - DNA, 521 bp, Canis familiaris
gccagcgctgctaccgagagaagaagttccgggaagccatcggcaagtatcatcgggcactgctgcagctgaaggcggctcagggggcccgccctggaggcctcgaggagcagcggcgcctggtggagaacacggaggtggaatgttatgactctctcaccgcctgcctgctgcagtcggagctggtgaactacgagcgggtgcgcgagtattgcctcaaggtcctggagaagcagcagggcaacttcaaggccacctaccgcgccggcattgccttctaccacctgggcgactatgctcgcgcgctgcgctacctgcaggaggcccgcagccgggagcccacagacaccaatgtcctccgctacatccagctgactcagctgaagatgcaccgttgcagcctccagcaggaagacagtcgggccggggccgggactcgagatgtcgttggctaaggccaacctagggggactttccctccccctactcccacctcagcgtgtaacttcccctgacttatg

SEQ ID NO: 10086 - DNA, 560 bp, Canis familiaris
  misc_feature (32)..(32): n is a, c, g, or t
  misc_feature (49)..(49): n is a, c, g, or t
  misc_feature (62)..(62): n is a, c, g, or t
  misc_feature (65)..(65): n is a, c, g, or t
  misc_feature (89)..(89): n is a, c, g, or t
  misc_feature (98)..(98): n is a, c, g, or t
  misc_feature (119)..(119): n is a, c, g, or t
  misc_feature (122)..(122): n is a, c, g, or t
  misc_feature (312)..(312): n is a, c, g, or t
tagctcaacaaaatcatccccaacacccatgnccctaagtattactagnggcatgccaaatnacntctctgaaatgcctcaacaaagcncaacccttnacttacggagggaagagacanccncaaatgtaaagactcgcttaccttctgtggcaagtgcgtggaaagtaaatgcttcatttctcttaatgctcaatgctgtggtcatgctggctgtttgagggtctgcattttttgaaactaatgaaagaactcctccctgatgtatagttgggaaaatatgcccctatctaaccagtgattcaagctattnaagtattcaagaaagtcagtcttacatttctgactctgatgtaaatgaagtaacttgtcttaaataaaagaagtgcacaatgtcttggtacttgctgctattttattgtcttaattaagtaaaactaatgagtttctttctttttaatgaaatgttttctttttaaggcttcaatttattgcacaaaatataaagcatctaaactttaatatgtattttatgtatgtttacactgtcaaacacccggg

SEQ ID NO: 10087 - DNA, 548 bp, Canis familiaris
  misc_feature (309)..(310): n is a, c, g, or t
  misc_feature (356)..(356): n is a, c, g, or t
  misc_feature (358)..(362): n is a, c, g, or t
  misc_feature (366)..(370): n is a, c, g, or t
  misc_feature (413)..(415): n is a, c, g, or t
  misc_feature (431)..(431): n is a, c, g, or t
  misc_feature (447)..(451): n is a, c, g, or t
  misc_feature (453)..(454): n is a, c, g, or t
agaatgctactgacctctctatagttctgtgaagcatagaaattttctgactagtgtcaacaaatgtgaaaacaagtatacatatgggatgaacacaacccttaagtttggggaaagtaaaaacaaggttgcttcttcctagggatctgtgtaccactggctcttttacaaacccaaggtataaaagatctagttcttttaaaaaaaggctctagatctaaccattactctctaaagcagcagagctaagtttgttacttaggatttcattttagcatctgtttaaactacttaaattggggtgcctgnntggctcagtgggttaaccatctgccttcagctcggatcatgatccnannnnnctgnnnnngagccccacattgggcttcctgctcaatgtggagtctgcttcnnnttctccctctgcctgntactccccctgcttgnnnnntnnctctgtcaaatgaataaataaaaatcttaaaaaaaaataaactacttagctgttagcacgattatgcatttggattttcttcatctgacctttt

SEQ ID NO: 10088 - DNA, 474 bp, Canis familiaris
tgcttggcctacgtccatgcttaaacctagggaaggggggattcttttggattcatggggtgaatggcagatgttctctccatgctggggaatgaggagggaggagtcagccagctttcatgctcatggtggcctggctttgactctccaaggagcaacacatacaactcagaggagtatctggctccaaagtttagggatggaaagacacttcttttggaaagacacccctttaggttcagagaaatagggggtgctttgctcccttggcctaccttatacagttgtcaatgcacacaaaatacagcctcatgctccctaaggcaagacccctgaaagtgatccatgcttttggctggcattctgcatgtctagtgattgtcttgggaatgtttcactgctacctgcacccagtgactttgcagcacagaacccgtttaatgtaactatgcagagctgtttggacttcatagt

SEQ ID NO: 10089 - DNA, 50 bp, Canis familiaris
ttcccctgacttatgtgtttgctggtaaagcccttgtcactggtgaccat

SEQ ID NO: 10090 - DNA, 514 bp, Canis familiaris
ggcaaggcacactttgttcctattttaaagcctccctccttgctgcataattcccccacccagacctctgagccactgtagctgctgcctcccaaccccagtaacactgctgggtgaagccactgtcctacatcagataattcccaccctccagtgacctgctgttttttcctaacccaagggctcttgtggttcccctcctactccaatgcaaaatgtaccctcatactgtaggtagcactatattttatcgtttggggaatggaggcacaaacagaatgaagactggtttgtgctctgctttccatgggaagactggggatgaggggcaggcacaggactatctgtgcccacaaatagggctgagagggtccgctccagggtcctcctcacccctccaaggccagaaaagtgagagtccttccctctttccaagacctggtgcccttcccctcactccctcctgccacctgctgctgctaaccctcggggtaccactgcagcctttacttac

SEQ ID NO: 10091 - DNA, 353 bp, Canis familiaris
  misc_feature (149)..(149): n is a, c, g, or t
  misc_feature (152)..(155): n is a, c, g, or t
cctcatctctgtgattgtgaattacagttcagttctcgtgtttttagactgttagacagaagtgctcgcgtgcagctccagaatatggaaacagagcaaaagaaccctaggaccttttttagaaacagtacgataaattatttttgagnacnnnncagtatatagtgatgtgctagaactttttaggctgattttagtgccccattattaacgattccccggaacatggaaataaccactgtttacagagctgagcattggtgacagggtctgacagggtcagtctaaaataaaatttggtggcaatattaggtaactttttttcctatgaagtcttttgtaggtccttgttg

SEQ ID NO: 10092 - DNA, 535 bp, Canis familiaris
aacacggagttctcggagctggagcttcaggagtggtacaagggcttcctcaaggactgtcccacgggcatcctcaacgtggacgagttcaagaagatctacgccaacttcttcccctatggtgacgcctctaaatttgctgagcacgtcttccgtacgttcgacaccaacagcgatggcaccattgacttccgggagttcatcatcgcgctgagtgtgacctcacgtggccgcctggagcagaagctcatgtgggccttcagcatgtatgacctggatggcaacggctacatcagccgcgaggagatgctcgagattgtgcaggccatttacaagatggtttcgtccgtaatgaagatgccggaggacgagtcgaccccagaaaagaggaccgagaagatcttccgccaaatggacacgaacaacgacggcaagctgtccctggaggagttcatccgcggagccaaaagcgacccgtccatcgtgcgtctgctgcagtgcgaccccagcagcgcctcccagttctgagcgagag

SEQ ID NO: 10093 - DNA, 410 bp, Canis familiaris
  misc_feature (92)..(93): n is a, c, g, or t
  misc_feature (181)..(182): n is a, c, g, or t
  misc_feature (200)..(200): n is a, c, g, or t
  misc_feature (229)..(229): n is a, c, g, or t
  misc_feature (241)..(241): n is a, c, g, or t
  misc_feature (248)..(248): n is a, c, g, or t
  misc_feature (296)..(296): n is a, c, g, or t
  misc_feature (342)..(347): n is a, c, g, or t
aaagctccaaaagctattctatgtaaagttcttaagtggggattcttgaccataatatttggcataataactctgataattctgtatgttanngggttttatgttctgatattttgactggtttgggaaaaacggagttgtcccaaagctgaactcagagttgtcccggtaaatgcttaannaccgactttttgggtggnaagccctgatccatagtgtttgtcaattnccatgacttaancactttnactatggctgattgcaggctgtgagagtgacatcactgagagcagaancggggatgatgtatgcagccgacccttgtaagttggtgtacccacnnnnnntccatgggcatgtgtgaaattgcagtttttttattaaaaattctgccccatagatatacaaag

SEQ ID NO: 10094 - DNA, 476 bp, Canis familiaris
  misc_feature (259)..(259): n is a, c, g, or t
acggaacaggccgacatctcactgacccggggagctgaggtgaagggccactgtggccacaacgagtcggagctgcaggtgttctgggtggatcgcgcgtatgcgctcaaaatgctgttcgtaaaggaaagtcgcaacgcgtccaagggaccggaggcgacgtggaggttgagcaaagtccagttcgtctacgactcctcggagaagacccattttaaagatgcagtcagtgctgggaagcacacggccaactcacatnacctctctgccttggtcaccccagctgggaagtcctatgagtgtcaagctcagcagtccatttcactagcctccagcgatccacagaagacagtcaccatgattctatccgcagtccacatccagccttttgacatcatctctgattttgtcttcagtgaagagcataagtgtccagtggatgagcgggagcagttggaggaaaccttgcccctgat

SEQ ID NO: 10095 - DNA, 528 bp, Canis familiaris
  misc_feature (26)..(26): n is a, c, g, or t
  misc_feature (120)..(120): n is a, c, g, or t
  misc_feature (275)..(275): n is a, c, g, or t
  misc_feature (336)..(336): n is a, c, g, or t
  misc_feature (338)..(338): n is a, c, g, or t
  misc_feature (363)..(363): n is a, c, g, or t
aatttaatcggtcctgtccatcaaangaaaatctagcgttccatgaggatggttcagtctgccacaacatcctgaaaaagaacgttccagacagaatgttcccccttctctttccactcnaaaagtgtagaaataacagtgggatggtagccatacagccgagtttccaccttataacacctgccctccaccgtgacaaacacgtattgtcagtttccaagtcttttgagaccagtggttcatccatgaaacttaccctcccatacacacagtgncctgtcattctggcttatgagctctaaggtggagtgagagcaggagactgccttgccaagnanagaaggacatctccatggtagtggnacccggagcctctctatcatttagatcctacagaaacttccctgctgtctgacttgtagtgcactcaggtcatgacacctggacaatgcatcctttgaaggatgggctttctcttgtccatcctagattcttcagcttcagaaccagctctgcattgtctccaat

SEQ ID NO: 10096 - DNA, 491 bp, Canis familiaris
aaaagctcctggtcctgaagtccggacctgccacctctgcctcttagaagacccttctacagggtgcatttcagggtcagagaagtgtaccatcagcagcacgtcaccgtgcatggtgatcaccatctattatgataccaagattcgtttcttcatccgaggctgtggacagtataattcctaccgctgccaagaaaaacgcaatacctacttcccggagtactggtaccaggcccagtgctgccagtatgattactgcaactcctggtccagcccccagctccacagctcccctcttgacccccctgctgggacctggggcctgcccctctctgagtcccagatccagtggttctaccgggccctgaacctctcgcttcccctccgcagcttccatgctgggggggagcctgaatgcctgggtaacctggccaccctgcccctgaatctgagcttatccattgctgacctgcgtcacatatatttgtttc

SEQ ID NO: 10097 - DNA, 468 bp, Canis familiaris
tgaagtgctgctcattcgcctgtgagaagaagtgtatggatccattccaagaaccctgcatgctaccctcagaccaaggaagctgtaacattgggctctcgcgctggtattttgactttaaacatcggatatgcaaaccgtttaaatatggaggctgctatgggaatgccaacaacttcatcagcagaggaaactgcagagtggcttgctcatcagttgtcaagactggacagtgcccactcttccccttcaagaaccgtatggagtgtccagcttcctgtaagggtgacatggattgccccaaaagtgacaaatgttgtgaatccatgtgtggctttgtttgtgccaaggcctggacagtcaaatcaggtttctgcccacgcaagcccctgatgtgttccaagattgagagacccaagtgcctgcaggatcgtgattgcccagtgtcccagaagtgctgttcacatt

SEQ ID NO: 10098 - DNA, 484 bp, Canis familiaris
tggaggacagcgatcagtccctgatggagctttggtctagcgactcggaggacacggccgaggccactaaaggagagggcagccggactacggagaacttggtgcttagcagcaaaggcgtgctgccccccggctggcccgaagaccccatcctcggtgaagacgaagtggcgggaaacaaggtgggaggggagcctctccttcccagcaacaaagcctaccttcggtctgacctgctggccagggaatgcaacaccctgatggcgcccaaggtgaagggtcacaaccgcacgtgcataagccagtacacgttcatccatgaggaccttgacaccgtccaggccgtctgcaacagtcccgtcgtggcctgtcagctcaagggaggcaaatgccacagaagctcccgtccttttgacttgaccttctgtaggttgtccaaaccgggccaggtcactcctcactgccattacgtcactttcatttt

SEQ ID NO: 10099 - DNA, 117 bp, Canis familiaris
tgcacaagagaaatggatccaatctgtgcaaccaatggccaaacttattccaatacatgcgttttctgcagtgaacaattagaaggttctaacaaatttaaattgtctcattttgga

SEQ ID NO: 10100 - DNA, 268 bp, Canis familiaris
ggaagttggtgtggcctccagccaaaacctggcactgaagaccccaaagaggctggaagccttgttcctgaccttgagcgggcacgaactgctggtgaaggctgcatattacagctcaggaagttgtgagacagaaaacatagtgggctcagagatagacatgtcggggacattcgtcttccctggtaagaaccgttgccctgttgctacaagcccccagctctgcgtgcccactacactggctttgctatctttctgcaccgtttcc

SEQ ID NO: 10101 - DNA, 174 bp, Canis familiaris
attttgcggttgtccctccactggcaaggcaaggacttccgtgtgctcaagtacttcacccgcagcctcgaggacgagaatgggccaggcttctggaggttccgggagctgaccgcagacacggggctttacctggtagcccggcacgggaggtgcgccaaactcctgaaggag

SEQ ID NO: 10102 - DNA, 458 bp, Canis familiaris
  misc_feature (171)..(171): n is a, c, g, or t
  misc_feature (429)..(429): n is a, c, g, or t
tgtcctgctgactgcttttgtggctttggtctcattgcctaggacccgggcagtgtggttgggaaggctggaccctaagcagcttctggggtcctggtatattctggccgtggcctcaggtgaaaagggctttgcattggagaaggccacgaagaacattgagggcgtcgntgtgtcccttactccagaaaacaacctgaaattgctgtcctctaggcacaggctggagaggtgtgacgtgaacgtggtggagctgctcagacagaactcgggatgggtgtttgagaaccccgccctaggcattctggactaccgtgtgctgggcaccaacttcagggattatgccatcgtgttcacccagctggagttcaaagacgaggccttcagcaccgtggagctgtacagccggacagaactggccagccaggnggccatgggcctcttcaccaggtggagct

SEQ ID NO: 10103 - DNA, 173 bp, Canis familiaris
tccatcaaagaactgcagagtccttggagaggcttcccaccagtttttcaagtccacactacatcacactgaaacctgcaaataaagatccaagaggaattgccgatcccaatcaaagttccaaaatgaacttgaaattggatatccaaaatggctgtgcaaggctaggttga

SEQ ID NO: 10104 - DNA, 550 bp, Canis familiaris
gctgcatgactctcctcataaagaacagcagcagcggttctgacatcatggtgagtgactgccgccacaaggagcagatgagtgattgttcatatacccgctcttctccagtgtttggcttctggatattttctcgatgctgcctccgggagttctgcaataaccctcagaacagagtcttctacattccttagaatttctgcaaagacttgtggaataaaatcctgccagttgccatccatcttcttgatttccagttggctggcacagccaggacaacttccaatcctttttaccagccctccctgcctctctcaagttactggcccccagccctgtctcttagttgacacccctcaagctccccgactcccactctgcccctcccccaggctccctctccagaagtctgagttttcaagtcctcacggtctgacagcttttgtcctcttctcccactcttcaagctgcttctttgcccggctttgcccatctcccaccacaagccagtctcgcctcaagtccccaggtgttcctcccaaataaattg

SEQ ID NO: 10105 - DNA, 136 bp, Canis familiaris
gggccattttaggtgctattctgggtgcttcattgcttagtcttgttggctacttgctgtgtggaaaaaggaaaacggattcattttcccatcggcgactttatgatgacagaaatgaaccagttctgcgattaga

SEQ ID NO: 10106 - DNA, 400 bp, Canis familiaris
ccaggatttacttgtgcagaaggagaatgctgtgaatcttgtcagatgaaaaaatcagggtccatatgcagaccagcaaaagatgaatgtgattttcctgaagtgtgtactggtcactctactgcatgtcctcaggacaaattccaagtaaatggatttccttgcaagaatgcaaaaggctactgcttcatggggaaatgtcccacccgggatgatcagtgctctgaattctttgataatgaggtgaaagacagttctgatctctgctatgagatgaataaaaaaggaaatagatttggatactgcaaaaacaaggaaaacagcttaattccctgtgaagagaaagatgtcaaatgtggaaagatacactgcagtagagggcagcattcatcactacttg

SEQ ID NO: 10107 - DNA, 382 bp, Canis familiaris
  misc_feature (140)..(140): n is a, c, g, or t
gttggccatctttatggccctggtggcccacacctaccaagtaagaaagaaaacctttctgagtgttggagaagtgtctgcatcagacccttatgtgacaaccaccatgcagtatttgagcgatgacttcaacaagaagnataacgacaagtacaatttccggattgtgcggctcctgaaggtccagaagcagattactgaccatatggagtttcatgtgaacatggaaatgcggcggaccacctgtcaaaagctggagactactaattgctcctttcaggaaggggagctttacaagcaaattgagtgcttctactcagtgtttgttgttccctggtttgaaaagtacaaaattctgaacaaaaactgcaccgatgactag

SEQ ID NO: 10108 - DNA, 236 bp, Canis familiaris
ttctcctacacatcatgctcacaaatgggtttgtgatgcttctgcctgtgctgggaggtgtcaaggacaagactttttttccagttggaagaagagccactgagcagtgctgggtacagcctctgttaaagtattgtaagaagaggtgcactaaattacaggagtgtttatctcccaatcatacatgttgctggaccttctgtggaaatatctgcttggacaatgaagaacccttt

SEQ ID NO: 10109 - DNA, 558 bp, Canis familiaris
  misc_feature (27)..(27): n is a, c, g, or t
  misc_feature (80)..(80): n is a, c, g, or t
  misc_feature (83)..(83): n is a, c, g, or t
ttctctgctctgtgatttctctggtcnccattcccctgtattttcagtgtctctggctttagtgtcattttcttcctagnaanctgggatgctgcacctcctagaaaataatgagttcagagtctgcccaggctggcctggggaaggcacagtggcttcctggtccccttctggtcaccagagtcagccatgcccctcatcttcccagtcctctgccaatctggtcccctgctgcctctgttcagatctgtttgtagatcacattctacgcctaccttgagacccagactgaacttgcagtaagaagggtagactaatgtgcacgtttccttactaggcactgtggtgtccctgcctcactgtgtctactcccacctgcttctctggtcaccttgccctggtcacctgcttctctcctctcgttgcagtccgtggtctcagtcccactccgcatcactgagtcctgaaacccgcttccatagatgccaggggagaggagagggtcccccctgctctgctccacatctcctgcttgttctccacaaactccacaataaa

SEQ ID NO: 10110 - DNA, 553 bp, Canis familiaris
  misc_feature (181)..(181): n is a, c, g, or t
atttcatttccttgttcttcatatgaagatttcaaagctggtttatgtgtaaactgtgagaagttcaagaaaaaatcatgtcctaggctaggttatcaagctgagctatggaaagatgctttaaaagaaagaaaagaaaaacaatttctcaagaccactgtgtttttggatactagtggcnaaagtccattctgtacctattattttgttctcagtataactcttctagataaaaccatgaaggatgcctatattacatttaaattattaaaccagtttggaaatgttgaagaaccaagtctctatgagaagaatacatcatttaataagctccaagaagtcaagattcttgctcaatttttaaatgatattgtaagtatttcaaggattggtttgacatattttcagagctcaaactggcaaagtttcacatacaaatacaacattcagcgtgtcaagttgcaatcacttacatatccagcaagaccaccactttgcatatacaattttgtacttaaagaaagtgaagaagtatttctcaatccaagcatat

SEQ ID NO: 10111 - DNA, 199 bp, Canis familiaris
tgacctgccagccatgaagtttttcctcttttttgtcatccttctggccatggaaccagtgatatcagaagagtgttggatgaatggaaaatgccggttggtgtgcaaaagtgatgaagacagtgtcgtacgctgcgaaaatcgtaaacggtgctgtgtccctagtcgctacttaacggtccagccaatgactgttgaa

SEQ ID NO: 10112 - DNA, 277 bp, Canis familiaris
atcattgcaatcctgctgttccagaagtccaaagtaactgaacaacttaagagatgctggggtgaatatatacgaggatattgcaggaaaatatgcagaataagtgaaatacgtgaagtactttgtgaaaatgggagatattgttgcctcaacatcgtggaattggaagcacgtagaaaaattacaaagccacctcctccagagccaaggacatatgcaatgactttccctcaagatgatgatataattgtagaaaattattcaagatccaagacaa

SEQ ID NO: 10113 - DNA, 243 bp, Canis familiaris
  misc_feature (130)..(130): n is a, c, g, or t
tgctgtttgcatcagaacgtgttggtatagaagccaaagctcggtccctatggctgctctctggggccatagcactgacccagacacaggtgtttttggagaagaggttaagcaagcatgctgctgcccnctcatttgatccagacagtctggacattttgttgtagcaaaagaaaggacaacaaccacctccgcctgactgtagagaaagtggcttagcaggagctggacaaaatatccaaa

SEQ ID NO: 10114 - DNA, 260 bp, Canis familiaris
tgaagctgtttctggttctcattattcttcaatttgaggtaccaacagatacagcacgacccagaaaatgctttagtaatataacaggctactgccggaagaaatgtaaaatgggggaaatatatgaaatggcatgtctaaatgggaaattatgttgtgttaatgaagacaaaaacaaaaaacaccaaaaagccccagagtcacctctccctttaccacagcctaaggggaagatagactatgtcattttacccaccatc

SEQ ID NO: 10115 - DNA, 322 bp, Canis familiaris
tctgctgggcatagtctttctgatctgctcaaataagggtgaattgaaggaacatctgacagagattgcaaagtcatgttataaatgtaaaaaatatcatcttgggttatgctatgacatcatgaagacctgtaccctaaagtaccaacagtcctgtgctgttgagaacttttacttccttacaaaaaaaggacggagtatgtatttttattccaaactgtcatgtgtgaccaattgcgaagacatcaacttcttgagttttgaaaaaaggacagagctcatctgttgcaaacatgctagctattgcaacctccctgaggga

SEQ ID NO: 10116 - DNA, 553 bp, Canis familiaris
atatgctgcagctttgggttatgaaggcctttttttatatgatgataggctcttggctgattcagataggctttatgctgtacaaaccaatttctggctataaatggatggatgatgacaaaaacaacattatatttgtcaccaccttcttctgctggcatgtggctttcattgccattttaatgatctgggtctatggcttctcctttttgtggtattattacatttgttgaggtatgaaccttggtgatcccagaatggcttttgtcacctgcacattctggaatacctagatgagaagttgtaggaagtggaggtgttagaaaggaagatgactgaggcaacagactttgttgggatggacatccacctctccccttctggcttctgagcagtctcatctgctgcgcagtatgctgggacaggcaaatgaaacccaagaagaagttatgaccttcactctcagctccccaagtatttcccctacctctcctacctctcaattccagatgaggcattctccttgtcttgttcttctctgtactcttcacat

SEQ ID NO: 10117 - DNA, 89 bp, Canis familiaris
agcagattactgaccatatggagtttcatgtgaacatggaaatgcggcggaccacctgtcaaaagctggagactactaattgctccttt

SEQ ID NO: 10118 - DNA, 261 bp, Canis familiaris
actccgagtgcgtcagtgactgctgcctaatgaacctggaccacggaggcgccttctgtgcccccaaggccagaatagccatgttgtgcctgttccaggtgaggctctgggctggggcagccagctctggcctgaaggaccaaaggagccctcaacgtcatatgcccctgccaaagcggcttgagttgcatatccaaggacccaatctgttcccgccgttgccatttgatttagaggaggatccaggctggtcgctgccac

SEQ ID NO: 10119 - DNA, 155 bp, Canis familiaris
ctgcccatgaaagagtttccggagatccttggaggctccaacaagtctctcgccctgcacttgatccaccgagtcctgcacatccccaaccagtacttatatcttgtggctgatcaatacttctacaacaagcactccccagttgagattcgaga

SEQ ID NO: 10120 - DNA, 154 bp, Canis familiaris
gtggccctaatgtttccaggaccatccagggccagaaatattaaccaccaaggtacagagggtcccagagaaccttgggaagaatctcctggacaaggaaaaaacgagtctcacttgctacaccaccgagaaaaacgtcgcctcttaccacgca

SEQ ID NO: 10121 - DNA, 186 bp, Canis familiaris
aggacgttcctctttctttttgctgttttcttccttctggccccagccaggaatgcattttttgatgagaaatgcttcaagcttaacgggaagtgcgtgcattcttgccagaaaaatgaagaactggtggctctctgccagaattttctgaaatgctgcctgacactccagccatgttggatgagt

SEQ ID NO: 10122 - DNA, 237 bp, Canis familiaris
aacagtacctgtgtctttccatttatgtttggtgacaccatctactacaactgcatctctgtccacagcgattatgattggtgttcactcgacaagaaattccgagggagatggcggtactgcaccggggaagatccccccaagtgtaccttccccttcttcttcagaagcaaactctttcacaaatgcaccaaagagggctatattttgaattggagttggtgctcattgacaaaa

SEQ ID NO: 10123 - DNA, 282 bp, Canis familiaris
caccgctgtatcacatggtcttatgtgctgattccagcggcacagcccgggaggttctcagtggatggcgcatcgggggcaaaccccgaggaagtccaggtgtatgacactgactacaatgtgttcgctctgatgctgttcagaaggcagtcaggtggccagagcatcctcagggttaacctgctctgcaggatgtggataatccagacccaggtgctggacaaatttgtctgcctggtcagagctctgggcctgtcggacaacaacatcgtcttcccagac

SEQ ID NO: 10124 - DNA, 336 bp, Canis familiaris
  misc_feature (33)..(33): n is a, c, g, or t
ctgcctccatctcagcttgataaaggctgtccncaggcagctcagtatatctggcttctcggtgttctccccagaagccctgtggccatgacacagctgcttctgctcattgtggctctcctggccctgggtcatatgcagccagggagaagtgaatttaaacggtgctggaagggccaaggggcctgccggacttactgtacgaggcaagaaacctacctacacatgtgcccagatgcctctctgtgctgtctcccctatggaagcaggcctctgtcctccaagcctgaatatgtgtagctggctctggggctggcacacttactctccaagaaa

SEQ ID NO: 10125 - DNA, 147 bp, Canis familiaris
caaggagatctgtgcgcatccaaatggctcttgccaggagttttgcctggaaacggaaatccaagccgggaggtgtttaaatggccacgcatgctgccggcccatggtgttcgagtccatcatcgagcctactacacccaaggaatg

SEQ ID NO: 10126 - DNA, 228 bp, Canis familiaris
gcttttgggacttctgtcagtcctagcactcttcatcctcttggggggagtccggaaacctgagctggttgaggggttacttgccatcaagtgtccccgtaccagaataccatgccgttacagagaaatcgaccaatgctcgaggagtaaaagctgccctgagaagatgacttgctgcaattttaactgttcaaagaaatgtttagacctcaaggaagaggctttcca

SEQ ID NO: 10127 - DNA, 412 bp, Canis familiaris
ttccttagcgaaactcactctatttatttttatttattcctgtttatttatttatttatttgcttccataccactggtattcagatccttcatgatgatccatttggtgagcttaatttgtacataacactccagaaacttcctgtagatcattcttaaaccatgttaacgagcaatgctgtcaatgcctactcatgtgcacctcgctcatggaagatatttcaaggtgtttttaaaggacaagagtgattattgcagccctcttctgaatttttaacgctgaagtttgaggcaacagggggcatgtagcgacaggaaaggaaactgcagaatgaaaggcattctgtgagaaggacagtaaagccagctgtttgacgcctgggcctggtatcttttaccaagtcacacattg

SEQ ID NO: 10128 - DNA, 199 bp, Canis familiaris
  misc_feature (110)..(110): n is a, c, g, or t
  misc_feature (141)..(141): n is a, c, g, or t
aaacgcctgtctctcttttttgtcaatcacaaaattttgaaataaataaacatcgcctaaatggaaaactctgtggatcgccgaaaaagagtgggattaaaactttgganccctaaaacttttattcaattgtaaaaatgnattatattgcatcgaaaaaattaaaaatattgatcattacttattacctctcttaaaa

SEQ ID NO: 10129 - DNA, 321 bp, Canis familiaris
gaatggatcttggtcttgggctgcctgttgttcagtgtctggttttctagttggttaagagccttccattgacaacgacagaagaaacatgtagctttaacagctctgcccaatcccctaaacagcatcagatgccaaagacccgaagatacttcatgggataaaaacacctctaatacaatttgcagtattttaaactaagaaagacactcattaattgattttagtggaggaagagggcagttttgggagaaggcagaaattggtgttgggaagcaggaggaagagctcatccatcttggagtgttgatgttcgtattc

SEQ ID NO: 10130 - DNA, 436 bp, Canis familiaris
gtataaacggacagctcttcacagagcatgcttagaaggacatttggcaattgtggagaagttaatggaagctggagcccagatcgaattccgcgatatgcttgaatccacagccctccactgggcaagccgcggaggaaacctggatgtcttaaaattgctactgaacaaaggagcaaaaatcagtgctcgggataagttgctcagcactgcgctgcacgtggcggtgaggactggccactatgagtgcgcggagcatctcatcgcctgtgaggcggacctcaatgccaaagaccgagaaggagatacccctctgcatgactcagtgaggctgaaccgttacaagatgatcagactcctgattatgtatggggctgacctcaacatcaagaattgtgctgggaagaccccaatggatctggtgctacactggcag

SEQ ID NO: 10131 - DNA, 309 bp, Canis familiaris
gtctgagcttgtgtgactgagagtcagtgtgtatgcgtgtgtgggcgtgttcaagtgagactgtgtgtcatcttgcatgtgtgtactaaagcacctgtggggggctgtgtgcaggctatggggcacctggtgaaatttttgagtcctttgcccacaagaagatcttgttcagaggcctgtgtttggttttcctgtacacgcaagtccgactcggcgcagcaggagtaagggtgtgtctgaggacatgacttgcagctgtttgcttgtgcatagatgtgggtgcctgagtcactggctgagttctcaccc

SEQ ID NO: 10132 - DNA, 423 bp, Canis familiaris
  misc_feature (55)..(55): n is a, c, g, or t
  misc_feature (60)..(60): n is a, c, g, or t
  misc_feature (68)..(68): n is a, c, g, or t
tactttgcaatgtaacccagcgggtgtcattctggtttgtggttacagatccttnaaaanatcacacncttcctgctgttgagatagagtcggccataagaatgaataggaaccggatcaacaatgccttctttttgaatgaccagtctctggaatttttaaaaattcctaccactcttgcaccacccactgacccatctgtgcccatctggattattatattcggtgtgatattttgcatcgtcatagtggcagtcgtgttattgattttatcaggaatccgggaacgtagaaggaagagcaaagaaccatctgaagcagatgacactgaagataagtgtgaaaacacgatcacaattgagaatggcatcccctgcgatcctctggacacgaagggagggcacattaatgacgccttcatga

SEQ ID NO: 10133 - DNA, 373 bp, Canis familiaris
aacctggttacctgggaactgctattcctcattacgatgtgcaggtcttggatgacaagggcaatgtcttgccccctggcatcgagggagacattggcatcagagtaaagcctatcaggcctataggcatcttctctggttatgtggacagtcctgagaagacagcagccagcattcgaggggatttttggatacttggagatcgggcaatcaaggatcaagacggctatttccggttcataggccggtcagatgatatcattaactccagtgggtatcggattgggccctcagaggtggagaatgcactgatggagcatcctgctgtaattgagacagctgtaatcagcagcccagaccctgtccgaaaaga

SEQ ID NO: 10134 - DNA, 55 bp, Canis familiaris
gttcataggccggtcagatgatatcattaactccagtgggtatcggattgggccc

SEQ ID NO: 10135 - DNA, 503 bp, Canis familiaris
ctttacccttccttacagataattgattcttatctgccatctcaccaagaaaatgagcatggtataattctaccaagggacttggccataaaacttgtgagtttatatctcaccaaggatgaaacatttgtcgaggcgatgagaagaaatgaacatatgcctcaggaatcaagacatctgtttcagtttgttaattggagcactcttttacccgagaagtataggaagggttatgtttatactgaaccaattcttggaaaacataatttttcatttccaggacttatggatattagaatatcacccttactagccaatgattccctgttacagaatttgccaccaacctatattcttacctgtcaatatgatattgtgagggatgatggacttatgtatgtttcaagacttcaaaatgttggagttcaagttactcatgaccatattgagaatggaatccatgcagctttatcatttatgacaccaccactgtatttacatgt

SEQ ID NO: 10136 - DNA, 359 bp, Canis familiaris
  misc_feature (53)..(53): n is a, c, g, or t
  misc_feature (85)..(85): n is a, c, g, or t
  misc_feature (144)..(144): n is a, c, g, or t
tccccaaggaagctacagcagcatgtgaagtcagtaccagccccatccaagtncccaaggaagggaactaaggcatgggagtggncactgaagggggacccagtttttggaggtggagtttgtttctgagctgcccaagactancacagggaaaatccagcggaagaagcttcgagacaaagagtggaagacatccaggcaagctgaggcccagtgagacctacatgggcatccctttgggccctacacttcttacttccatttccctttggactttctgttttcctctagggatagaagatttccttatgacaagacaacttatttctgtctttccctggaaagcacaaaatcttact

SEQ ID NO: 10137 - DNA, 592 bp, Canis familiaris
  misc_feature (221)..(221): n is a, c, g, or t
aggtcacctcaaacctcaggacacacatgaccagaggaggggaatatccactattgagtaatttccatatgccagacactgtcctaagcattttataaatactatcatgttttacctctgtgtggcatctacaaactttggcacataggtgtgagaacactataggaacctcaaaaaagtgtcccttccccatggctcatgtttgtggtagtatctactcnttcctagaatcaagtaattgttgggccagtgggatcaagggggatcaggaggcaccaactaaatggcggcagaccctccatcttgttaccctcccctcagaactttcccaccaccggcagaccgcccaaggacacatcatcaggtggagacaggacctatgcaggaaacctgaaccacaccttacccaaaccccatataagggcataagcagttatcaccccatacagacacaactccctacccctctccccttaaaagctcacatgtactccctttgggcgcgccttccctggcccatgactccccactctctccctctcctgtgggccatggaaccttgcctgagagcacgtctcattaaaagcttgcc

SEQ ID NO: 10138 - DNA, 263 bp, Canis familiaris
  misc_feature (233)..(233): n is a, c, g, or t
ggtggagtttgtttctgagctgcccaagactaacacagggaaaatccagcggaagaagcttcgagacaaagagtggaagacatccaggcaagctgaggcccagtgagacctacatgggcatccctttgggccctacacttcttacttccatttccctttggactttctgttttcctctagggatagaagattccttatgacaagacaacttatttctgtctttccctggaaancacaaaatcttactgtattagatgttgaaa

SEQ ID NO: 10139 - DNA, 153 bp, Canis familiaris
gaagtgatgcaaaatcttgcagcgactaaatccttccaagtcaagcaaacacagtgctttctctttttcttggctaatacaataaagaaactggttccttccctgctggatgtaaagaagttagcacccggtggtggcaaaccgaagcccatc

SEQ ID NO: 10140 - DNA, 135 bp, Canis familiaris
caggctaggatacccaaagctgagggtgcctgggacatccacccatccgtggggacaagatacatgtcctgttgtgcttaagcatctgatgatctgactgaagaagctgacagatttccaaactttggctggacc

SEQ ID NO: 10141 - DNA, 300 bp, Canis familiaris
  misc_feature (43)..(43): n is a, c, g, or t
  misc_feature (132)..(132): n is a, c, g, or t
  misc_feature (183)..(183): n is a, c, g, or t
  misc_feature (199)..(199): n is a, c, g, or t
  misc_feature (255)..(255): n is a, c, g, or t
  misc_feature (258)..(258): n is a, c, g, or t
  misc_feature (271)..(272): n is a, c, g, or t
gggactccaaatgaccaggcagtgttgcgggccatcttcaacncccgacaccccgtttggagaccttgttgggttggacgtggaagaggaggtagagaaggaagaagtagatgaagatgaggtttttcctcnagcgcagctggagcagtccaaggccctggagctccagggggtgatggcggnggaggccggccacctnagcacggccctggagaggtttggccaagccattgacctgctgccccagagggcctncgnctacaacaaccgnncccaggcccgccggctgcaaggagacgt

SEQ ID NO: 10142 - DNA, 371 bp, Canis familiaris
atgcatttattcacaatcccactggaacacacttctgtgaggttgaacagatgagaagtggacctccagtcattcattctggaatcaaagatctcaaggtcttgaaaacgacccagtctggattcgaaggattcatcaaggaccagttcaccaccctccctgaggtgaaggaccggtgttttgccaccaaagtgtactgcaaatggcgctatcaccagggcagagacgtggactttgaggctacctgggatactgttcgggacattgtcctggagaaatttgctggaccctatgacaagggcgagtactcaccctctgtccagaagaccctctatgacatccaggtgcactctttgagtcgggttcctgag

SEQ ID NO: 10143 - DNA, 346 bp, Canis familiaris
agaacaccaggtttagagccacatggatttaacttctggggaaagcttgaaaacaacattgtcaagggcctggaagaagaattcataagaattcaggctaaagaagagtcagaggaaaaagaggaacagatggctgaatttcagaaacaaaaagaagtgttactctccttatttgatgagaaacgtcatgaacatctctatagtaaaggtgaaagacgattgtcatacagagcacttcagggggccttgatgatatatttttacagggaagagcctagattccaggtgccttttcagttgctgacttctctcatggacatagacacactcatgactaaatggagat

SEQ ID NO: 10144 - DNA, 412 bp, Canis familiaris
  misc_feature (384)..(384): n is a, c, g, or t
atgatattgttgctgtgggacctgagcacttttacgccacaaatgatcactattttactgatgtctacttgaaatcctgggagctctatttgggtttagcgtggtcttatgttgtttactatagtccaactgaagttcaagtgatggcagacggatttgattttgctaatggaatcaacatttcacctgacggcaagtatgtctatatatctgaattgctggctcataagattcatgtgtatgaaaagcacgctaattggactttaactccattgaagtccctggactttaataccctcgtggataatatatccgtggatcctgtgacaggggacctttgggttggatgccatcccaatggcataaggatcttcttctatgacncggagaatcctcccgcatcagaggtgat

SEQ ID NO: 10145 - DNA, 431 bp, Canis familiaris
  misc_feature (27)..(29): n is a, c, g, or t
  misc_feature (203)..(203): n is a, c, g, or t
  misc_feature (303)..(308): n is a, c, g, or t
  misc_feature (361)..(362): n is a, c, g, or t
  misc_feature (369)..(371): n is a, c, g, or t
  misc_feature (378)..(378): n is a, c, g, or t
aatgggttgggtgctacaccaccttcnnntaagctctgttttgttccagtctgaagaaaggccaggccgccagattgcaaagccacactgacctcacctgaacaagccagatgcttttctgtcttatgtgtcagccaccatccacctctcctttcacatcaggaaggacattcctgaccctttcttttcattgtctttatccnttaagattcagttcaaatttccctgtatgaaacaaaattcttttttgtaatccagtcctaagatttcatgctgtatctcatatgcagtgtataccaatgnnnnnnactttattgtcatattttcttccattaaaaattaaaaattgggacgcctgggnngctcagnnntttagancctgccttcggccccagggcctgatcctggagtcctggaattaagtcccatat

SEQ ID NO: 10146 - DNA, 398 bp, Canis familiaris
  misc_feature (156)..(156): n is a, c, g, or t
  misc_feature (264)..(264): n is a, c, g, or t
  misc_feature (361)..(361): n is a, c, g, or t
aagaaacacagatctccctgagaataaatactcgagggattattcaacctgaaaaacccgttgttctcaaggttgagccaagagatgggagtgtaagtggagcctgactttcctaaggacttcccctttgttctttaagaagctggatcccagaanaccagagacctcaattttctttatgagtaaaacccaaaaatgaagatgggcttcacgtacagcctgtgatggatgactgggaattccatacattcatttagctttctncgatgtctatgtcaagcattatatattgtgtaaagaagtgactaataagtgtcagacatgtagactcaacctatccggttcacacagactacccccngtttgtaccatctactctcctgagaactgatcaagaa

SEQ ID NO: 10147 - DNA, 461 bp, Canis familiaris
ggtcatcggccccttgacaagaagagggaagaggctcccagcctgagacctgctccccctcccatcagtggaggtggctatcgagctcgtccagtcaaaccagtagccagccaaaagaaattagaaagaaaagcccctgatgctgggggctgtcttcatgctgacccagatctgggagtgttgtgtcctacaggatgtcagttgcaagatactttggtaaaacaggaaaggccaatcagaaaaagtatagatgaattaaataataatgtggagtctgtgtcccagtcctcttctagcacctttcagtatataactctgctaaaagacatgtggaaaaacaggcagaagcaaataagagataatgaaaatgcaataaatgagtattcctcagagctggaaaagcaccaattatatatagaggagactgtgaccagcaatattccaactaaccttcgtgtgct

SEQ ID NO: 10148 - DNA, 206 bp, Canis familiaris
ttgcttagagccgtgtactattaacgtggatcgcatgtacagaaataacatagagatgaagtggaagtatgaaggaaaagtcttacatggagatttaatagattttgtatgtaaacaaggatatgacttatctccatcaaactcattgtctgaattgtctgtacagtgcaatagaggagaagtgagatatcctttatgtattagaa

SEQ ID NO: 10149 - DNA, 388 bp, Canis familiaris
  misc_feature (198)..(198): n is a, c, g, or t
caaaagcagaaactgtggccctcctgagaatccagctcatggctattttgaagggggagatttcagctcaggatctaccattacttatcactgtgaagacggataccacttagtgggcacacaggaccaacagtgcattgatggggagtggaacagtgcacttccagtctgtaaattgatccaagaaactcccaaacngactccacagactgagtgtgagaagacaatttttgcctttcagaaggacatagaatattgcaaagccatagaagactttatgcaaagactaaaggaaaatggcttaacaatggaggagctaaaacattctctggaaataaagaaagctgtgttgttggccaaaatgtcctgacattgtagctgagcagac

SEQ ID NO: 10150 - DNA, 153 bp, Canis familiaris
  misc_feature (62)..(62): n is a, c, g, or t
gtgtgcggtcttagatctagtgttggaaccaccctgggaacatctgatggcctaacctaagnaaaaccagagctcctggggagacgagtgggataatccctgcttttatcagctacaatatctttatacaatgatgtttgataatttgctata

SEQ ID NO: 10151 - DNA, 337 bp, Canis familiaris
  misc_feature (227)..(227): n is a, c, g, or t
ttagaccgagaatccaggtccccagcttggtactacatctattataatcccgcatctaagaaaatgacaagatagagatcactgcagggattttgaagaattctaaatttaaagactgaatttaaagacagagtccatcatcttaaaagacaacagggttcctaggaggaaagaggatttttcaaattaagtggaatatttgaagtattagcatttgtttattttanacattatattatcacccattaaaaatgcatgatgaagatgttaaaggcataacatactttaagtttcgtaccttaagctgaaggtgacctcaattctgcacattaacaaa

SEQ ID NO: 10152 - DNA, 451 bp, Canis familiaris
  misc_feature (368)..(368): n is a, c, g, or t
agcgagtactacatcctcactgcggctcactgtctccagcaagccaagaaattcacggtgagggtaggtgaacgggacacagacaaggaggagggcaacgaggtggcacacgaggtggaaatgatcatcaagcacaacaagtttgtcagggagacatacgactttgacatcgcggtcatcaagctgaagacgcccatcaccttccgcatgaacgtggcgcccgcctgcctgccgcagaaggactgggccgagtccacactcatgacgcagaagacaggcattgtaagcggcttcgggaaaacccacgagaagggccgcccgtccaccaccctcaagatgatggaggtgccgtatgtggacaggaacanatgcaagctgtccagcagtttcagcatcacccagaacatgttctgtgccggctatgactcgaagcccgaagacgcctgtcagg

SEQ ID NO: 10153 - DNA, 334 bp, Canis familiaris
  misc_feature (201)..(201): n is a, c, g, or t
gacatccctgagatacaacatcctgcccaagaaagaaggcaaagttcccttcaatctgaaggttgatactttccccaagaattgtgatggagtagacactcacaggaaattccagattcacatcaacattagttatactggggaacgatcaagctccaacatggtcattgttgacgtgaagatggtatcaggcttcatacncgtgaaatcatcagtgagaaagctccaagaaaagcctcagattcaaaggactgaagtgagcaccaaccatgttctgatttactttgaagagctaaccaatcaaactctgagtttctccttctcagtggaacaa

SEQ ID NO: 10154 - DNA, 415 bp, Canis familiaris
  misc_feature (39)..(39): n is a, c, g, or t
  misc_feature (52)..(52): n is a, c, g, or t
  misc_feature (56)..(56): n is a, c, g, or t
agaacatggtgatctcctttggagatggggttactttcntggttgtcctgcnccangtgtggaagaagcaccctgtccaccaggactttctgggcttctacgtggtggacagtcaccggatgtcagcacagacccatgggctgctgggacaattcttccaaccctttgactttaaagtgtctgacatccacccaggctctgaccccacaaagccagatgccacgatggtggtgaagaaccatcggctgacggttaccaggggctcccagaaagactacagaaaggacgtcaacattggcactaaggtcgcctgctggtttgtccacaacaatgggcaagggctgattgatggtgtccacagggactacatcatcccagacctgttctgagtagacatgtcagctcctgtggaaac

SEQ ID NO: 10155 - DNA, 497 bp, Canis familiaris
  misc_feature (49)..(49): n is a, c, g, or t
  misc_feature (62)..(62): n is a, c, g, or t
  misc_feature (145)..(145): n is a, c, g, or t
  misc_feature (171)..(171): n is a, c, g, or t
gagaagtaaaatgcccattcccatcaagaccagacaatgggtttgtganctatcctgcaaancaaatcctttattacaaggataaagccatgtatggttgccatgatacgtataccttggatggcccagaagtagtggaatgtancaaatttggaaactggtctgcacagncaagttgtaaagcatcttgtaaattatctgttaaaaaagctactgtgctataccaaggagagagagtaaagcttcaagaaaaatttaaggatggaatgctgcatggtcaaaaagtttctttctactgcaagaataaggaaaagaagtgtagctacacagaagatgctgagtgcatagatggcaccattgaaatccccaaatgcttcaaggaacacagctctctggctttctggaaaaccgatgcatcagatgtaaagccatgctaaactggttttcagattcagaattaaaggccatactggaatcggtgtctgtccaaggaacat

SEQ ID NO: 10156 - DNA, 95 bp, Canis familiaris
gattatttttattcttctatatgtaacaacgtttttatatattatgtcattggaatattctttcacacattgtatccccctaaaactatcaaaga

SEQ ID NO: 10157 - DNA, 333 bp, Canis familiaris
  misc_feature (32)..(32): n is a, c, g, or t
  misc_feature (46)..(46): n is a, c, g, or t
  misc_feature (49)..(49): n is a, c, g, or t
  misc_feature (52)..(52): n is a, c, g, or t
  misc_feature (68)..(68): n is a, c, g, or t
  misc_feature (89)..(89): n is a, c, g, or t
  misc_feature (115)..(115): n is a, c, g, or t
ctggcaatgccctcatagaaggagcttctcanctgtttggagaganccnaanccatgaccatccacancggcatgtatttcagcacgtncgacagagacaatgatggctggatanctacagatcccaaaaaacagtgtgctagagaagatggtggtggatggtggtataatagatgtcatgcagccaatccaaatggcagatactactggggtggacattacagctgggacatggcaaaacatggcacagatgatggagtggtatggatgaactggaaggggtcctggtattcaatgaagaagatgtctatgaagatcagacccttcttccca

SEQ ID NO: 10158 - DNA, 209 bp, Canis familiaris
  misc_feature (27)..(27): n is a, c, g, or t
  misc_feature (143)..(143): n is a, c, g, or t
  misc_feature (147)..(147): n is a, c, g, or t
  misc_feature (149)..(149): n is a, c, g, or t
  misc_feature (175)..(175): n is a, c, g, or t
aggggtccaaacctcggtgctgcggcncaagctgccttagtctgaaagaacccaataaccaaccccctcagccttccctgagaataagagaaaaaaagagaaatggagccctagagcttattcatctgtttttcttttcctgntggngnaaaaccaaccctctatcttaagaacncaaattcttttaaacattttgcctcttttctctg

SEQ ID NO: 10159 - DNA, 233 bp, Canis familiaris
  misc_feature (94)..(94): n is a, c, g, or t
  misc_feature (99)..(99): n is a, c, g, or t
  misc_feature (120)..(120): n is a, c, g, or t
  misc_feature (155)..(155): n is a, c, g, or t
gagaaaggccagcagcccccccttggggggagccaaacaggctggcgacatttaaaaagcccatttcaaaaagtgatctgctttttttaaaggnctttncctgacagaaaaaatataatnttttccctttgggacaatggacttacaaagcctcncttcattttaagggtaaaaagaacccatgttgagaactccactatcagttttatgctggtgataatttatcaacaggc

SEQ ID NO: 10160 - DNA, 385 bp, Canis familiaris
  misc_feature (61)..(61): n is a, c, g, or t
  misc_feature (319)..(319): n is a, c, g, or t
  misc_feature (324)..(324): n is a, c, g, or t
  misc_feature (326)..(328): n is a, c, g, or t
  misc_feature (334)..(334): n is a, c, g, or t
  misc_feature (336)..(336): n is a, c, g, or t
  misc_feature (338)..(340): n is a, c, g, or t
gtatcatttgactctttgtggtctcatcatgtcatctggaagtgtaaataatgagactacnccgttgacttatacacagggctgcatcccttctgaaccatccaaggcctcacacaccatggacagatgcctctctgcctctcctgtcttcagcctctccctctgtaatcttactgcctgttagctaagtctctgacatagggactgccatattcagaaatgtcctcttctttctgggcaaaagcacattgtgagtcttttgatcaaaataagattaaaatggaaggatatcaagaaactggggagatgcctgggtggntcagngnnngagcancngnnnttggctcagagcattatcctggattcctgggttcaagtcccacat

SEQ ID NO: 10161 - DNA, 594 bp, Canis familiaris
gtggaggctctcaaaaatctggcagccagaagtggttgggaggttaccagtgtggtggaaaaggtaggaggcatccagaatgacattttatctgtttgggttgagaaacatgtggaaaggcctgcacacttgacttaccatctcttgtctgactttaccaagagacctttgtgggacccccattacgtgtcctgtgaagtcatagactgcgtgagtgaagatgatcagatatattatatcacttgtcctgtagtgaatggtgacaaacccaaagacttggtagtacttgtatcacgaagaaggcctctcaaagatggcaacacttacacggtggcagtgaagtcggttactctaccatcagttccaccttctcctcagtacagcagaagtgaaattttatgtgctggatttctcatccatgctattgacagcagttcctgtaccgtatcatacttcaaccagatttctgctagcatctccccttactttgctggaaatcttggtggctggtcaaaatccatcgaagagacagcagcctcttgtatacaattcatagagaatgctactgatgatgggttgatagacatattttaa

SEQ ID NO: 10162 - DNA, 418 bp, Canis familiaris
acttaccatctcttgtctgactttaccaagagacctttgtgggacccccattacgtgtcctgtgaagtcatagactgcgtgagtgaagatgatcagatatattatatcacttgtcctgtagtgaatggtgacaaacccaaagacttggtagtacttgtatcacgaagaaggcctctcaaagatggcaacacttacacggtggcagtgaagtcggttactctaccatcagttccaccttctcctcagtacagcagaagtgaaattttatgtgctggatttctcatccatgctattgacagcagttcctgtaccgtatcatacttcaaccagatttctgctagcatctccccttactttgctggaaatcttggtggctggtcaaaatccatcgaagagacagcagcctcttgtatacaat

SEQ ID NO: 10163 - DNA, 342 bp, Canis familiaris
gtatgagtcattccagtgagccatctcactcccccttttctggtttcaggttctctaggcaaccttttgattataattaggccttccatattgaattttctaaagagttgctgaccaacctctgcatgtactttagtgtgttaggctggctccctttatgaattaataaactgttgttctggttgatactgtagctttttgtgaatgtggctgatgtgaatcagtcatcccacatgttgttatatatgagactactgacaaaatcatgtttgggaccactttgacctgaccaagctgctgccttcacctcacccccagccaggcatttactttagtccttca

SEQ ID NO: 10164 - DNA, 555 bp, Canis familiaris
tgttgacccaggttttgcgccaccagcctttcctgggctaccgcggggcacgagaactgtcggaacgaaagttggtgcgggatgtgcggcgcaagggcgacgtttacttcaacaccggcgacgtgttggccatggatgaagaaggcttcctttactttcgcgaccgccttggggacaccttccgatggaaaggtgagaacgtgtccacgcgggaggtagagagcgttttgtcactggtggacttcctgcaggaggtgaacgtctatggtgtgtcagtaccaggttgtgagggcaaggtgggcatggctgcggtgcagctggcccccggccagacttttgatggtcagaggatgtaccagcatgtccgcacttggctccctgcctatgctgcaccccatttcatccgcatccaggacactctagcgatcacaagcacattcaaactggtgaagtcccgcttggtgcgtgagggcttcaatgtaggcgtaattactgaccccttgttcgtgttggacaaccaagccaaggccttccggcccctgacagtggacatgt

SEQ ID NO: 10165 - DNA, 531 bp, Canis familiaris
  misc_feature (42)..(42): n is a, c, g, or t
  misc_feature (225)..(225): n is a, c, g, or t
  misc_feature (256)..(256): n is a, c, g, or t
  misc_feature (269)..(269): n is a, c, g, or t
  misc_feature (316)..(316): n is a, c, g, or t
  misc_feature (388)..(388): n is a, c, g, or t
  misc_feature (414)..(414): n is a, c, g, or t
caagaaaccagacaccttagggccaaatactcggctgtatangtggcttccccagaatgaccttcttggtcatccgaaaaccaaagcctttataacccatggtggaaccaacggcatctatgaggcgatctaccacgggatccccatggtgggcattcccttgtttgccgatcaagctgataacattgttcacatgaaagctaagggagcagctatcagactggncttcagcacaatgtctagtgcagacttgctngatgcattgaggncggtcattaatgacccttcgtacaaagagaatgctatgaagttatcnggaattcaccacgatcagcctataaagcccctggaccgggcagtcttctggatcgagtatgtcatgcgccancaaggagccaagcacctgcggccagnctcccatgacctcacctggttccagtaccactccttggatgtgattgggtttctgctggcctgtgtggcaactgctatatttgtcaccacacaatgttgtctgttttgttgtcggaa

SEQ ID NO: 10166 - DNA, 329 bp, Canis familiaris
  misc_feature (239)..(239): n is a, c, g, or t
gcaggtggagagtcatgctcggtgtccatgatgtaccaggaaggcaagttccgctaccggcgggtggcagaaggcacccaggtgctcgagctgcccttcaagggggacgacatcaccatggtgctcatcctgcccaagcctgagaagagcctggccaaggtggagcaggagctcaccccggaggtgctgcaggaatggctggatgaaatgacggagaccctgctggtggtccacatgcnttgcttccgcatggaggacagcttcagcgtgaaggagcgcctgcaggacatgggcctcgtggacctgttcaaccccgagaagtccaggct

SEQ ID NO: 10167 - DNA, 66 bp, Canis familiaris
tctgcactgctgactgacaaccatggtgccacatatgccttcagtgggtcccactactggcgtctg

SEQ ID NO: 10168 - DNA, 66 bp, Canis familiaris
aggacagcctgccagagtcggctttctcagtggtccaggtcttccgaagccatgggtacccgatac

SEQ ID NO: 10169 - DNA, 188 bp, Canis familiaris
ggttctgttgcttgtcctcctggtattgggatttgaggtccagggggcccatgagtcccagcaagatgaaaccaccagctccgccctgctcacccagatgcaggaatcactctacagttactggggcacagccagatcggctgccgaggacctgtacaagaaggcatacccaactaccatggatgaga

SEQ ID NO: 10170 - DNA, 246 bp, Canis familiaris
  misc_feature (26)..(26): n is a, c, g, or t
  misc_feature (34)..(35): n is a, c, g, or t
  misc_feature (136)..(136): n is a, c, g, or t
  misc_feature (155)..(155): n is a, c, g, or t
  misc_feature (165)..(165): n is a, c, g, or t
gcctgtgttgtggcaagcagcgcccncagaatcnncgagcccccccccgaggctggtgagtagtccttggagcctggtggccaccaaggtgaaggaggtggtgtccaggcccagagagaagtggcagtggtttttntgggccggaggccttccanggctttgtgnagacctacttcgatgaccacttgaaggacctgactctccgtacccgggcctggctccgcagctccaaagacagccttgtga

SEQ ID NO: 10171 - DNA, 320 bp, Canis familiaris
  misc_feature (50)..(50): n is a, c, g, or t
  misc_feature (126)..(126): n is a, c, g, or t
gaaggcaattcagtgtgatcaactagagaaagcaaaagataaaaggaacnccaaagaagagtctttctccagcattggcagcagcaactatcagaactaaccagccttgcctggagggaggacaanggagcctccatgaagagcctcacccatccaccgcttagagattggtacttgtttaaaaaaatgaagattttgttcaaggacagccttatgaaagcagaaaccaaaattgccttttgttcctgaatttccagcgttccatagccctaaagggcactcaacttttgaactaggctatagaggcttttaccctacaa

SEQ ID NO: 10172 - DNA, 534 bp, Canis familiaris
  misc_feature (78)..(78): n is a, c, g, or t
  misc_feature (86)..(86): n is a, c, g, or t
  misc_feature (132)..(132): n is a, c, g, or t
  misc_feature (354)..(354): n is a, c, g, or t
  misc_feature (356)..(356): n is a, c, g, or t
ttcagttgctgagaccaggctggctagcctagagagggagataaggagcctgaaatcagaactgggccacatcaaaancttgcaanccttctccttgggcaaaaagactggaaagaagctctacgtgagcancggcgaaaagatgtctttttctaaagtgaaggctctgtgtgccgagctccaggccactgtggccacccctaagagtgctgaggagaacaaagccatccaagatgtggccaaggaagaggccttcctgggcatcacggacaaggtgaccgaaggccacttcatgtatgtgaccggagggagcctggtctacagcaactggaggaagaatgagccaaacaaccncnggctcgggggaggactgtgtgatcctcctccaggatgggttctggaatgacatctcctgcgagtcctccttcctggccgtctgtgaactcccagcctgatgaggcagcttcctcagccccctcccggcattcctgctgtgctctctgctgccctgaaagagaattcatggtccccttt

SEQ ID NO: 10173 - DNA, 57 bp, Canis familiaris
acccctcggtgaccagacttggaataaaatggctggttctgtctgctgttttccata

SEQ ID NO: 10174 - DNA, 106 bp, Canis familiaris
gtgacacagttttaaggagttccaggaactaactgctaatcaaagagcaaaatagaggaaggaaaatcaggatcatccgcagatactggaaaactctgtaaaataa

SEQ ID NO: 10175 - DNA, 155 bp, Canis familiaris
gggcccctttcagaggtctgtgcgtgcagcctggcctctctgcaccgaggagccacgtgccaggctctgccctgctcatcctttagaaggtgccagtgactacctggtggcttccagggagcctatgggctttttgatctgaggccctgaggtct

SEQ ID NO: 10176 - DNA, 203 bp, Canis familiaris
  misc_feature (77)..(77): n is a, c, g, or t
aaaatcaggcccctggagaccaggtaggagtggaagtgagagtaatctgttttctttgtttagggaggtgaagaagnaaaaaaaaatggggaagataaagtagttaagattctttacaatccactaaaaaaattcacaggtgctattttattatttcttgtactgtatctaaatgtaactgagacatattactgctttaaaga

SEQ ID NO: 10177 - DNA, 237 bp, Canis familiaris
  misc_feature (29)..(29): n is a, c, g, or t
tctcacgcgggcatgcagttcagcacgtncgacagggatgcagaccagtgggaagagaactgtgcagaagtctacggaggaggctggtggtacaacagctgccaagcggccaatctcaatggcatctactaccctgggggctcctatgatccaaggaacaacagtccttatgagattgaaaatggagtggtctgggtccccttcagaggtgcagattattccctcagggctgttcgc

SEQ ID NO: 10178 - DNA, 451 bp, Canis familiaris
  misc_feature (422)..(422): n is a, c, g, or t
agaaagcgccgagtgcaccatgtcctgagccccgaggggacagaggcctgcttccagctgcgagatgtctcggtggtagactcagccaactacagctgtgtctacaaggacactgcgccacccttcgccggctctgctccaagctcgagcttggaactgcgcattgatggaccccctcccaggccacagctccaggctctgtggagtggggctatgattcctggacgtgatgccatcctgcgctgcaagggccaggtgccggaagtcgtgccgcacatcacttttgagctgttgcaggaaggcaaaaaggagccttcaacccaggtctgggccacccacccctcagcggaccttgtactgacctatgtggggccccagcacgcaggcaactacagctgccgctatcgctcatggttgcccanccccttcgtgtctgagctcagtgacccag

SEQ ID NO: 10179 - DNA, 308 bp, Canis familiaris
ctacctggtaggcttatccgtctctcctgaaaacaccatctctcagagtgggttctgcagaaccttcctctcatgcaaagtgcagacagaggaagggaaagtatctgtgggaaacttagtttgggaaataatgcgtatcttgacaagtcctgcagtacggaaactggttattgtgagtaacacagtgtcttgcaaatgttaccctccactctcctacctcactttattgttttcctctatgcttattccacatcctgtggaattcaagtccatccaaaggaacacaaggcaatccacgtgtgtaattt

SEQ ID NO: 10180 - DNA, 219 bp, Canis familiaris
  misc_feature (144)..(144): n is a, c, g, or t
atgggagacagagtgattcatcaacatacctagaagccagaacacgggtagggaatttagcatgctcagaaataattgacagtaatcaaatcaagacactgtacttataccatctactgccaaacctcaacgttttttagtatnattgtggataaatgtttcccgtgcgtggactgttggattctgtaataataagtgacacatctataacatttattg

SEQ ID NO: 10181 - DNA, 166 bp, Canis familiaris
  misc_feature (30)..(30): n is a, c, g, or t
  misc_feature (32)..(32): n is a, c, g, or t
  misc_feature (38)..(38): n is a, c, g, or t
  misc_feature (43)..(43): n is a, c, g, or t
  misc_feature (51)..(51): n is a, c, g, or t
  misc_feature (126)..(126): n is a, c, g, or t
tgatctcaagccagtgccctggtgctgcgnanagaganggganggacgggnagggcaatccgggcggccctaactgggctcaggctgccacagctcagtttccaacaggctgcgtctcagcccggnccaggcctgcgttcctgtccgagccatggcaaagctgatg

SEQ ID NO: 10182 - DNA, 423 bp, Canis familiaris
  misc_feature (61)..(61): n is a, c, g, or t
  misc_feature (69)..(69): n is a, c, g, or t
  misc_feature (105)..(105): n is a, c, g, or t
  misc_feature (116)..(116): n is a, c, g, or t
  misc_feature (150)..(150): n is a, c, g, or t
  misc_feature (266)..(266): n is a, c, g, or t
  misc_feature (293)..(293): n is a, c, g, or t
tggcaaagctgatggtgctcaccctcttggggctgggactagcgctcttcagagatcaccngggcttcnttatctaacacgactcaatgctttccgagaagtaanccccagtagancttcctaactgtaatttagttaaaggaatagaanctggctctgaagacttggagatacttcctaatggactagctttcattagctctggattaagatatcctggaataaagagctttgaacctgataaacctggcaaaatgcttctagtngacctgaatgaagaagatcaaacagtnttagaactgaagatcattggaagtaaattcgatgagtactcatttaaccctcatgggattagcacattcacagatgaagataatactgtgtacctgctggtggtgaaccatccagattttaagtccacag

SEQ ID NO: 10183 - DNA, 556 bp, Canis familiaris
  misc_feature (89)..(89): n is a, c, g, or t
  misc_feature (105)..(105): n is a, c, g, or t
  misc_feature (123)..(123): n is a, c, g, or t
  misc_feature (149)..(149): n is a, c, g, or t
  misc_feature (162)..(162): n is a, c, g, or t
  misc_feature (175)..(175): n is a, c, g, or t
  misc_feature (177)..(177): n is a, c, g, or t
  misc_feature (181)..(181): n is a, c, g, or t
  misc_feature (183)..(183): n is a, c, g, or t
  misc_feature (188)..(188): n is a, c, g, or t
  misc_feature (190)..(190): n is a, c, g, or t
  misc_feature (219)..(219): n is a, c, g, or t
  misc_feature (243)..(243): n is a, c, g, or t
  misc_feature (250)..(250): n is a, c, g, or t
  misc_feature (284)..(284): n is a, c, g, or t
  misc_feature (292)..(292): n is a, c, g, or t
  misc_feature (299)..(299): n is a, c, g, or t
  misc_feature (416)..(416): n is a, c, g, or t
  misc_feature (450)..(450): n is a, c, g, or t
tcccacaacaccaaatcactgtaggtgctctaaaattttatcagtagttttgagaaaagagtttcctcttccttggttttgcaaaagancaagataaatgctccnttaaaattaaggcggggnaaaaaataaatgaataaaaatttttnaaaaaaataaggngggaaggggctcncntttntnttttntnaaaaaaaaaaatgtgtaagaggctggatncgaatttggatgcaggatgtctgnctacccncctcaagcgacgtgagcaactaggttcttgcagnccctgggnccccaangggaaaggtggctggaagcgcagcaaacatccctgccccagtttccatgggctgcttgcgcctctccaaacaccaccgcgtcctcttggctcccccgttgctaggcaaccgcctagnccgccgggctgggtcagaccaggacacccccccngcccgcgccccgtcactgctcagtgcacattttccgcgcaaatgaatgaacggctgtagttatttgcaacaacagatgcgcggcatcgccaacagctgtggattgt

SEQ ID NO: 10184 - DNA, 515 bp, Canis familiaris
  misc_feature (32)..(32): n is a, c, g, or t
tggagactctgaccatctggccagtccacaanacatctgaagtggtagtgcccaatgctgactaccactcccattgtgcagggtcaccttcccctcaaacctggtaaaggtcatcatgaatcccagcctggccataaccccagctccagagtgagatgatgctaggcccagtagtggagtgagaataaacttggatgtgtacacagatatctatgtgtacaggggccaagggcagacagccccaagattggtcactttggcataaagatcattttgtgttaaaagcattaaaacctgagcaaattcagaagctttctctcccaaaaataactatgttgataggaatctagcaagggctctttgatcacattcttgtcttgtttctgaatggcccaaagaccatttgtttaccgagtatttactctttcatcttcctttaaattgcattctttcctataaaattcctagacctctctcagttcagtatatgtatgccttattttgcctgtctttag

SEQ ID NO: 10185 - DNA, 491 bp, Canis familiaris
ggtggagaccacagcatggctattggaagcatctctggccatgccagggtccacccagatctctgtgtcatttgggtggatgctcacactgatatcaacactccactgacaaccacaagtgggaacttgcacggacaacctgtgtctttcctcctgaaggaactaaaaggaaagggcatagagttatactctttattaattgtaggattatcttactatctcctctttcatagctacattttgaaaactctgggtattaaatatttttcaatgactgaagtggataaactgggaattggcaaggtgatggaagaagcactcagctatctactaggaagaaaaaaaagaccaattcatctgagctttgatgttgatggattggacccatccttcacaccagctacgggcacaccagtcacgggaggtctgtcttacagagaaggtctctacattacagaagaaatttacaaaacagggctactctcaggatt

SEQ ID NO: 10186 - DNA, 75 bp, Canis familiaris
aagttgtgaacccaatggaagtataattgggaaataggctgttggctaattgcatgtgcttgttgcaataggaaa

SEQ ID NO: 10187 - DNA, 406 bp, Canis familiaris
gacacacaatcacaactttcggctgaatgagcgagaggcggtcaaagtttccatgatgcagaccaaagggaactttctagcagcaaatgaccaggagctggactgtgatatcctgcaactggagtatgtggggggcatcagcatgctaatcgtggtcccgcacaagctgtctgggatgaagacacttgaggcacagctgacaccccaggtggtggagagatggcagaaaagcatgaccaacagaactcgagaggtacttctgcctaaattcaaactggagaagaactacaacctggtagaggccctgaagtcaatgggggtcacagcactgtttgacaaagaaagcaatatgaccggaatctcagaccacaggatcaccattgatctgttcaagcaccaaggtacc

SEQ ID NO: 10188 - DNA, 518 bp, Canis familiaris
  misc_feature (181)..(181): n is a, c, g, or t
ggtgctgacggcagcccattgcctggagagatcctcgaggcctgcatcatataaggtcatcctgggtgcacataaagaagtcaatcttgaatcagatgttcaggagatagaggtgtacaagctgttcttggagcccacacgtgcagacatcgccttgttgaagctgagcagccctgctgtnatcacctcaaaggtaatcccagcttgtctgccacccccaaattatgtggttgctgaccggacattatgttacatcactggctggggagaaacccaaggcacgtatggtgcggggctcctcaaggaagcccagctgcctgtgattgagaacaaagtgtgtaatcgctatgagtatctgaatggaagagtcaaatcgacagagctttgcgcggggaatttggctggaggcacagacagttgtcagggtgacagtggaggacctctggtttgcttcgagaaggacaagtacattttacaaggagtcacttcttggggtcttggctgtgcccgtcccaata

SEQ ID NO: 10189 - DNA, 85 bp, Canis familiaris
gctgcaatcattgagaggagggctcttgagattattctggcccggccccttctctctgttttcctcacaataaaaaccacagtgc

SEQ ID NO: 10190 - DNA, 458 bp, Canis familiaris
  misc_feature (68)..(68): n is a, c, g, or t
atgctgccttttcctgggacaataaagtctacctaatccaaggcactcaggtatatatcttcctgacnaaagggaggctatactctagtagatggttatccgaagaggctggagaaggaatttgggagccctcatgggatcaaccttgagactgtggatgcagcctttacttgtcctgggacttctcgtctccacattgcagcaggacgacatctgtggtggctggacctgaagttaggagctcaagccacatggacggaggttccttggccacatgagaaggttgacggggccctgtgtatagaaaagtccctcggccccaactcatgttctgccaatggtcccggcttatatctcatccatggctccgatttgtactgctacagtgatgtggagaaactgagcacagccaagtcccttccacagccccagagagtgaagagcctcctgggctgcaa

SEQ ID NO: 10191 - DNA, 543 bp, Canis familiaris
gttaaatcaggtagctcatggacattaattcaacaccgaatagatggatcacaaaacttcaatgaaacttgggaaaactacagatatggttttgggaggcttgacggagaattttggttgggtctagagaagatatattccatagtaaagcaatctaattacattttgcgaattgaactagaagactggaatgacaacaagcattatattgaatatttctttcacttgggaaatcatgagaccaactatacattacaccttgttgaaattactggcaatattctcaatgcactcccagaacacaaagatttggtgttttctacttgggatcacaaggcaaaaggacatgtcaactgtccagaaagttattcaggaggctggtggtggcacaatgtttgtggggaaaacaacctaaatggtaaatataacaagcaaagagccaaaactaagccagagagaagaagaggattatactggaagtctcaaaatggaaggttatactctatcaaatcaacgaaaatgttgatccatccaatagattca

SEQ ID NO: 10192 - DNA, 251 bp, Canis familiaris
acctgaacaaactcctgtggtccaggagtgctaccacggcaatgggcagagttatcgaggcacatcatccactactatcacaggaagaaaatgtcagtcttggtcatctatgacaccacaccgacatgagaagaccccagaacacttcccggaggctggcctgacgatgaactactgcaggaaccccgacgccgacaaaagcccttggtgttacaccaccgacccctctgtgcgctgggagttctgtaact

SEQ ID NO: 10193 - DNA, 478 bp, Canis familiaris
gagaaggtcaactccatggactttggagaatttgtggatgtgtttgggaacgtcattgagagatgtcctctgatcgcggctgctgtttggtcccagcgtccattctccaacttggaagatttagagaagcatttttttgacttcattgatgcccttccccagtcaggccgagagggcatcctgcgctgccacccggacctggcgggccgcgagctgcagcagggcacgctcagcgccgagtctcggcgggagcagagcggcgcgggcctggcgagcctggacgcggacgagcggctccggctggcggagctcaacgcgcagtaccgcgcgcgcttcggcttccccttcgtgctcgccgcgcgtcggagccaccgggcggccgtgccccgcgagctggcgcgccggctgcgctgtccgcccgcgcaggagctgcgcaccgccctggccgaggtgaagaagatcggccacctgcgactcg

SEQ ID NO: 10194 - DNA, 410 bp, Canis familiaris
tgcaccattgggatcttcctcaaagccaaacggccacagtatgtacgctatatcaaaaagggagggatgatcatcatgcttttgttaagtgtggccataacagcactgtctgtcatcaacgtgggcaagagtatcaggtttgtcatgacaccacacttgctggccacctcctctctaatgcctttcatcggcttcctgctgggctacatcctctctgctctcttccgcctcgacggacggtgcagccgcactgtcagtatggaaaccggatgccaaaatgttcagctttgttccaccattctcaatgtgacattcccccctgaagtcattggaccacttttcttcttccctctcctctacatgattttccagcttggggaaggggttttcctgatctccatctttcggtg

SEQ ID NO: 10195 - DNA, 399 bp, Canis familiaris
  misc_feature (95)..(95): n is a, c, g, or t
  misc_feature (148)..(148): n is a, c, g, or t
  misc_feature (177)..(177): n is a, c, g, or t
  misc_feature (274)..(274): n is a, c, g, or t
ctgcaaggccttagttcaccaacctctttctgttctcaaagccattctccaaataagatatattacagaggggtaggcgcctgcctcttaaatgncaatctcccctaacagtcctgcctccctgacaggccacctccgagattacggngctccccaattctgcacatatttaaaatngctctggacattacctcacatggctaattgcacccagtgttgagttactataaattctgagactatcacagttccaaattctctgaaagccacacgnttcactcagatttaatgattctgaacacagaggcttcctgagtattccttgcggaccttttgcatttaagcaactcctgagactaatgccatttacattttaaaccctgtgcgattagactttgt

SEQ ID NO: 10196 - DNA, 512 bp, Canis familiaris
aggagctgcaccgtagcgtggtcccgcacgccgccgccagccccgcgcgcctcagccgctgcgtgcagatgctgtcgcgcaagctcacgctcaaggccgaggctctgcacgcgcgcatccagcagaacctggaccagctgcgggaagagctcagcgcttttgcgggcgccggtgctgacggcgcggatgagggggcggaccccgacccccagatgctgtcccaggaggtgcaccagcgactccaggccttccgccacgacaccttcctgcagatcgccgacttcacccgtgccatcgaccaggagacccaggaggtccagttgcagctggccccgcccccgccaggtcacagtgccttcgccccagagtttctccaagctgacagcagcgaggcccggagcaagctgcaggcccgtctccaagacctatgggaggacataaactacagccttcatgaccttggtctcagtcatctagaggagccctgagggtctacttgtccaggctcactg

SEQ ID NO: 10197 - DNA, 141 bp, Canis familiaris
agtgaggtctcttgaccagtgggcagaatcgtcacgcctgacacagtagctccaacaacctctatcatcaggccccgcatggaaggacaagaagatgggataaaatttaaagagaaaaatgccacctactattctgttgct

SEQ ID NO: 10198 - DNA, 405 bp, Canis familiaris
  misc_feature (81)..(81): n is a, c, g, or t
ctcaagtcccagatcagggaaggaaatgttctgttcaaaggtggcaaaacctggcaggattgtgactacaaagaatctacncaagctgccacgggagaatgctccgcgcccgtggggaagagagggaaaacgaagttctccgtggctacgcagacctgccaaatcactcccgccgagggtcctgtggtgacagcccagtatgactgccttggctgtgtgcaccccatctcaggaggcaggggcagagccagagccagcacctgagagtgaggtctcttgaccagtgggcagaatcgtcacgcctgacacagtagctccaacaacctctatcatcaggccccgcatggaaggacaagaagatgggataaaatttaaagagaaaaatgccacctactattctgttgc

SEQ ID NO: 10199 - DNA, 247 bp, Canis familiaris
ggaatgggctttattcaccttggaaaacagattcttcagaggtgggatgagaggaagggaaattattgagcaaatattctctgtcgggtccatgcaaaagtgttaacacatttacttcacctataactcacatgcaaaagaaaactgattatgattatgattttctatgcaaaagaaaactgattatgcccattttacaggtggcaaatcttaaataattcccaaggaatctacaacaatgaccaaa

SEQ ID NO: 10200 - DNA, 286 bp, Canis familiaris
tccaggctcccaggtattgttgcagaaggccggaatgacctctttgtctcagatgcattccacaaggcctttcttgaggtaaatgaggaaggcagtgaagcagcagcaagtactgttattgggattgctggccgttcgctgaaccccaacagggtgaccttcaaggccaacaggcccttcctggttcttatacgggaagttgctctgaacactattatcttcatgggcagagtagccaacccttgtgataactgaagtgttccattttggtttgtgatagtagtaa

SEQ ID NO: 10201 - DNA, 114 bp, Canis familiaris
aaccaggtaccttagcatccctcaggcttgtgtctgaaccccagaggccactcatggagtgggggctggattgctgaatggcaatatttgaaacattaaagaggacatgtgaca

SEQ ID NO: 10202 - DNA, 397 bp, Canis familiaris
  misc_feature (91)..(91): n is a, c, g, or t
cagacagtggccttgcagagcgtgagctcacccaggttggccaggagaccgtggtgactggctggggctaccgcagtgagactaaaagaanccgcacctttgtcctcaactttatcaacatccctgtggccccgcacaacgagtgcatccaggccatgtacaacatgatatctgagaacatgctgtgtgcgggcatccttggggactcacgggatgcctgtgagggggacagtggggggcctatggttacgtccttccgtggcacctggttcctggtgggcctggtgagctggggcgagggctgtgggcgcctccacaattatggcatttacactaaagtcagccgctaccttgactggatccacagccacattagaggtgaggaggcctccctcga

SEQ ID NO: 10203 - DNA, 382 bp, Canis familiaris
  misc_feature (93)..(93): n is a, c, g, or t
  misc_feature (110)..(110): n is a, c, g, or t
ttgtgctgtcttgatttcgactgcactggctggaccatgggctaatatctgtgctggcaggtcttccaatgagatcaggacatgtgacagccncggttgtggccagtacnctgcccaaagaaatcacaggcttcaccagggtgtggatgtcttgtgttctgatggatctactgtgtatgcacctttcaccggaatgattgtgggccaggagaagccttataaaaacaaaaatgccattaataatggtgttcggatatctggaagaggtttctgtattaaaatgttctacattaagcctgttaaatataaaggttctatcaagaagggagaaaaactgggaactctattgcccttgcagaaagtctatcctggcatacagtcc

SEQ ID NO: 10204 - DNA, 223 bp, Canis familiaris
tcttcagcttcttctgtaaggatgtcaaacaaggtgcaatcccagtcctctacctgagcttggcaaaggagctggatggtgtttctggaaaatattttagcagttcctgtatgataactctccccactgaagctgctcaggatcctcaagtggcccaaagcctctggaatgcctcagtccagctaacgaacctagacaagatggactgatcctctgtgacccc

SEQ ID NO: 10205 - DNA, 331 bp, Canis familiaris
  misc_feature (26)..(26): n is a, c, g, or t
actcctgctttgcatggccagtcaanaattcctgaatcgcttaacaactctcccacctgctgcctgaggcatcatgagaaagttttgccaaagaaactggtggcgggatacagaaaggccctcaactgctacctgccggcaatcatctttgtcaccaaaaagaaccgagacatctgctccaaccctcaagacaaatgggtccaagagtacatcaaggatcccaaaatacctttgctgcctcccagaaacatggccagggctaaaagcattaggtcataggaaggccacaccacagctctccatgaccatcaggccttggtgggagtccaca

SEQ ID NO: 10206 - DNA, 196 bp, Canis familiaris
gaatcagattaaaaccatctgcaaaaatctatgaagacatcgattactcaatctgtgttttttaaaattttctatgaatttcatgatatacaaagagtcctaatgtaatatatgtatatactataggtaagccctgtggtcctttgattcaatcctgtaaataattttattaactcatttttgtgataagactaaa

SEQ ID NO: 10207 - DNA, 85 bp, Canis familiaris
tctctattggtaaataaaactccacatttccggccatctatcaatttaattcattaaaatggaatcacagataaatcaattcagt

SEQ ID NO: 10208 - DNA, 311 bp, Canis familiaris
tttggcccaggaacatagccgccattttgtccaagtctgggtatgggtgggggccttgtttgctatcgaagcaggtgctatgcaggtctagattaatatcaagtcttcaatcccaacttctcttcattcttcagagaatggaagcagaggggcaatgttatgtttcatggaaggtataataaggttggcaacttgattgttattgttttgatgctaagccaccaccattgtgttctctcccttctttgacctcacaaaaacaattggaactgtgactttgagaggtgctcttgccaacttcatattttctt

SEQ ID NO: 10209 - DNA, 459 bp, Canis familiaris
acatcccgggactggccagcaaggtcttctccgcgcagaaggccttcataaccctgacaaatgaaatgatccaggagcacaggaagacccgggaccccacccagccaccccgacacctgatcgacgccttcgtggatgagatagaaaaagtgaggaggaaccccaagaccagcttcaatgaggagaacctgtgcatggtgacctctgacctgttcgtcgctgggatggtgtccacctcaatcacgctgacctgggccctcctgctcatgatcctgcacccggacgtgcagcgacgtgtccagcaggagatagatgaggtgatagggcgggagcagctaccagagatgggagaccagacccgtatgcccttcaccgtggccgtgatccatgaggtgcagcgttttggggacatcgtcccactcggtgtgccccacatgacgtcccgagacactgaagtgc

SEQ ID NO: 10210 - DNA, 357 bp, Canis familiaris
  misc_feature (86)..(86): n is a, c, g, or t
  misc_feature (161)..(161): n is a, c, g, or t
aaacccaacaacgaatggcattttgctcagaaaacatggatgggcaacagctcccccaaacccaggagaaaacctttgtgaggtgngacataaactctcaaaaattgaagaggaagatcagatgagctttcatgaagccccggcgggaagaataaatgatnctgatgcctcatctggaatggttactttctttggaaacccaagttatataaacaatcttgcataaagtttaaacaaagtttagcttcaagggaggagtgtgtttcactattctaaactgaacagtttaaaaaactatattatgtaacagtattcaaatattggtgtaactaaaaatttcccgattgtatctttgat

SEQ ID NO: 10211 - DNA, 273 bp, Canis familiaris
gtaaaaatctcacagctaatgtcataattagctaatctaataatttacttaagcttacagttatcctcccaaagatttggtctttctgaaaaatgttctgccttgtaaagtattagtataattaatatgagctaccaattccctcttggtgtgaaattcaagacttggaaatcctaacttttgtgtaattaaaaagacacatagggtgggactcttgatatcaggagataaagataccccacctgaaaagagaccatattcccaggttgttca

SEQ ID NO: 10212 - DNA, 474 bp, Canis familiaris
  misc_feature (26)..(27): n is a, c, g, or t
  misc_feature (30)..(31): n is a, c, g, or t
  misc_feature (36)..(36): n is a, c, g, or t
  misc_feature (40)..(41): n is a, c, g, or t
  misc_feature (47)..(47): n is a, c, g, or t
  misc_feature (254)..(254): n is a, c, g, or t
  misc_feature (257)..(257): n is a, c, g, or t
  misc_feature (260)..(260): n is a, c, g, or t
  misc_feature (286)..(286): n is a, c, g, or t
ctttgcatagtctttattccagtttnnacnntacantccnntttatncctagaaaaggaagaaagaaggaaagaaataaggaagcaagcaggcaatctaaggataggggccagagcctggggagcagatggacgatggacataagggcttgcaaatgagtcacataggaaaccccagcattcttgcaatccttatgtgcaatgaaaaatccttaaaataaatacacctccaaatctctgaataattggataagnacntcnttagaattaaaaaaagtttcatttanttcagacctgggaattccatgttgatcctatgcctgcctcatttattcacacatatgcctccacggaatttgagttggcagcaggaagtattttttttattttccggagtgtcgcactattacggacagtcgggtccccaaatgaaagtgactctgaatgtgaaaggccattcgtttctcatttattt

SEQ ID NO: 10213 - DNA, 247 bp, Canis familiaris
tcagcactcagaagaaagaggtccaggtaaaaagcactttcccttccaccggagacaaatcggatatgtttaccgactccctccactaaagaaagatgaagttcttcctcttcccgaagccaatttccccagcttctcattgccagaccacagccatcctctaaagccagagatccagcccttccctgaatcagtttctgaatcatgtccaggggtatttaagaatgacttttcaaatatctcaaaa

SEQ ID NO: 10214 - DNA, 128 bp, Canis familiaris
gggatattaataagcacggtgtcgaggaaacggcagccgaatgcagaaaactgggagccactgtgcatacatttgtggtggactgcggtaaccgcgaagacatttataactccgtaaagcaggtgaag

SEQ ID NO: 10215 - DNA, 289 bp, Canis familiaris
ctacttcttcaaggggagacagtactgggagtatgagttccagcagcagcccagtcaggaggagtgtgagggcagctccctgtccaccgtgtttgaacactttgccctgctgcagagggacagctgggagaccttcttctcagaagacaagtactaccgagtcaaccttcgcacacggcgagtggacactgtgagccctccttacccacgctccatcgcccagtactggctaggctgctcagcccccagcccccagtaggaatctgagcctacacagctgatccctcca

SEQ ID NO: 10216 - DNA, 449 bp, Canis familiaris
  misc_feature (423)..(423): n is a, c, g, or t
aaaggaggacgtgtctcctgtccttgctgctcattggcctctggggctgtgtggtctgtccgtggagcccgggggaggacatctgcacagccaagcctcgggacattcctgtgaatcccatgtgcatttaccgttccccagagaagaaggcagttgaggacgagggcgcagagcagaagatccccgaggccaccaaccggcgagtctgggaactgtcaagagccaattcccgcttcgccactgccttctatcagcacgtggcagactccaagaatgacaacgacaacattttcctctcgcccctgagtatctccacagcttttgctatgaccaagctgggagcttgtaacaacaccctcaagcagctgatggaggttttcaagtttgataccatctctgagaaaacgtccgatcaggtgcacnttttctttgccaaactcaactgccga

SEQ ID NO: 10217 - DNA, 218 bp, Canis familiaris
  misc_feature (116)..(116): n is a, c, g, or t
tgctgcgagctctagcaggtcaatttgcacccccatgccacagacactgtgagcccgccatttcaactgcttgccacttccctggggccacagtgatctcatctaaacagtgaatnctgaccctgaattggacatgtggaaggatgaaagtgctgtttaactgggaatggaatcaatgcataaggctttttttgaaagtactgtagcaaatcagtcta

SEQ ID NO: 10218 - DNA, 333 bp, Canis familiaris
agacctatctcttcaagggtagtcagtactggcgcttcgaggatggtgttctggacccagattacccccgcaacatctctgaaggcttcaagggcattccggacaacgtggacgcagcctttgctctccctgctcgcagctacagtggccgggagcgggtctacttcttcaaggggagacagtactgggagtatgagttccagcagcagcccagtcaggaggagtgtgagggcagctccctgtccaccgtgtttgaacactttgccctgctgcagagggacagctgggagaccttcttctcagaagacaagtactaccgagtcaaccttcgca

SEQ ID NO: 10219 - DNA, 488 bp, Canis familiaris
  misc_feature (82)..(82): n is a, c, g, or t
  misc_feature (219)..(219): n is a, c, g, or t
tggagaacagctggcggcagcaccgggaggccacggcatatctgcatgagcgcctgcaggggctgggtctgcagctcttcgngaaggatcccgccgcccggctgcccaccgtcaccactgtggccgcgcccgccggctacgactggagagacatcgtcaactacgtcatggaccacttcgacatcgagatcacgggcggccttgggccctccgtggggnaggtgcttcggatcggcctgctgggctgtaacgccacccgagagaacgtggaccgcgtgacccacgccctgcaggaggccctgcggcactgcccccggcacaagctgtgacctggccgcctgctgctccccgacctggaggggccgagagcaaaggaccctgccagcggggggcgggggagcaggacagccgctgccccgggcgggccaggctagcgggagggcgggacggccgcggcacctcctggaaatggaccctgtgggctcagg

SEQ ID NO: 10220 - DNA, 489 bp, Canis familiaris
atgtactcagtgttcaaccccagtgaccatgacctggtcttgatccggctgaagaagaagggggaccgctgtgccatccgctcccagtttgtccagcccatctgcctgcctgagcccagcagccccttccccgctgggcacaagtgccaaattgcgggctggggccaccaggatgagaatgtgagtggctactccagctccctgcgggaggcgctggtccccctggtcgcagaccacaagtgcagcagccctgaggtgtacggagcagacattagccccaacatgctgtgtgcaggttacttcgactgcaagtctgatgcctgccagggggactcaggcgggcccctggcctgtgagaagaacggcgtggcctacctatacggcatcatcagttggggtgacggctgtgggaggcttaacaaacctggcgtctatacccgtgtagccaagtacgtggactggatcaaagaccggatatggccctctaaa

SEQ ID NO: 10221 - DNA, 351 bp, Canis familiaris
  misc_feature (38)..(38): n is a, c, g, or t
  misc_feature (205)..(205): n is a, c, g, or t
ctcacacctactgaagcaattgaaaagtgtaaaattanccctgaaggagaagactcccccagagactcctctataaatgctgagagtaaatttcaatttacatattccaaaaatgaaatttaccaactattcttgacacattcttctaagaaggaaaaagtgtttctgcatgtgaaaggagtaattcatctgggaagatttgtgntgagaagtcgggatgtcatgctgacaaccactttcttggatgatataaaagctctgccatctacctatgaaaagggagaatattttgcatttttggaaacctatggaactcactatagcagctctgggtctctaggagggtactat

SEQ ID NO: 10222 - DNA, 536 bp, Canis familiaris
  misc_feature (30)..(30): n is a, c, g, or t
  misc_feature (51)..(51): n is a, c, g, or t
  misc_feature (253)..(253): n is a, c, g, or t
  misc_feature (284)..(287): n is a, c, g, or t
tcgctggactggtacttgtgtctgaggccngccctgcgggcactagtggancccaagtgtcctctgatggtcaaagtcctagacgctgtccgaggcagccctgctgtcaatgtggccgtgaaagtgttcaaaaagactgctgatgagacctgggaaccctttgcctccgggaaaaccagtgaatttggagagctccatgggctcacgactgttgagaaatttgtagaaggggtatacaaagtggaattagacnccaagtcctactggaagtcacttggcatttnnnnccgttccatgaatatgcagaggtggtgttcacagccaatgactctggcctccgccactacaccatcgctgccctgctcagcccctactcctactccacgacagcccttgtcagcaaccccaaagaatgaaggactcctcctttggtggatttgaaggagaaaggacaggattttgtgtaaccagtagtattccgtttttattaaagcagtgttttcactttataagctatcctagaaactcgggcagag

SEQ ID NO: 10223 - DNA, 438 bp, Canis familiaris
cttggcttcacagggagagaaaggtgttcaagatgtccttgagatactaaaggaagaattccgattggccatggctttgagtgggtgccagaatgtgaaagtcatcgacaagacattggtgaggaaaaatcctttggccgtttccaagatctgacagtgcacaatattttcccatctgtattattttttttcggcatgtattacttgacaaagagacactgtgcagagagtgaccacagtctgcaatcccccacttcaacacaaagggtgtcgttcttctccaacaaaatagcaatccctttgagctcattgcttttgacttttcaatgggtgtcctaggaaccttttagaaagaaatggacttgcatcctggaaatatattaactgttaaaaagaaaacattgaaaatgtgtttagacaacgtcatcccctggcagg

SEQ ID NO: 10224 - DNA, 290 bp, Canis familiaris
gagtctacctctgaggactgcatggccaaggagctacctgaatacacagtaaaaatctgtgataacttatccacaaagaattctaagttcaaggactgttgtcaagaaaaaacgcccatggacatttttgtgtgcgcttacttcatgccagctgctccaacacctgagctgccagccattgagttgcctgcaaatgcggatgtatgtgataaaggaaacaccaaagccatagatcagtatacatttgaattaagtaggagaactcatcttccagaagtattcctcagtaa

SEQ ID NO: 10225 - DNA, 400 bp, Canis familiaris
ggcggtccttgtggcagtgacattaacagtgcccattgtcctgtttccaattcgtacatcagtgaccacactcttatttcccaaaagacccttcagttggataagacatttcttaattgcagccatacttcttgcactcaataatgttctggtcatccttgtgccaactataaaatacatctttggattcataggggcttcttctgccactatgctgatcttcattcttccagcagtgttttatcttaaacttgtcaagaaagaacctttcaggtcaccacagaaggttggggctttaattttccttgtggttggaatcatcttcatgattggaagcatggctctcattataattgactggatttacaatcccccaaattccaagcatcactaacccaag

SEQ ID NO: 10226 - DNA, 438 bp, Canis familiaris
  misc_feature (375)..(391): n is a, c, g, or t
  misc_feature (393)..(393): n is a, c, g, or t
  misc_feature (397)..(400): n is a, c, g, or t
  misc_feature (403)..(404): n is a, c, g, or t
  misc_feature (406)..(406): n is a, c, g, or t
ggtgttattttcttgtctcctgtatgaaagagttctactagtagctcagcaaggtgttttgtgattagtcattataacatgctttttggatacagtttacttcacaaatgctaagcagtattagaatagtcataaatcaatatttctttttagttgtcttgcaccttcctgtcttagagaggttttagaatcaatttactaagaaaataatcatgaattaatggacgtgtcgtatcaattaatttgtgcacaaatttaagtgcaagcattgttttcaacctactaatgctcaaactttgcttctgggcaatgcagaaaatgtaatgacaaaatcatattttaaaaactatcaccaggggtgcttgggtggctcannnnnnnnnnnnnnnnntntggnnnnggnncngatcctggggtcctaggattgactaccgcatc

SEQ ID NO: 10227 - DNA, 417 bp, Canis familiaris
  misc_feature (81)..(81): n is a, c, g, or t
  misc_feature (100)..(100): n is a, c, g, or t
  misc_feature (196)..(196): n is a, c, g, or t
tagaaaaatccacccatcgtctttgtaagtatttgaggtttatttgagcttttaaaggagaaggcaccagtattagaagtncttgaggggaaagaaattnccaggattttcttactaagataatcagtaatccagcctcatcctgcagtgcacagaaagagagccaaagcagcacggctttcagaagctgcatgcngctgaggtgcaataaaaggagtgtcatttttttcttacaaagttgctataagaaccatttctcactctcagtttcagtatttcatattccattcacaggtgatagaaacttttattcaacttaactgttctattactaagtaagatggatgcccctttaatactcttttcagaactttattgccacactaaactttatttctatcactcttacatcctttg

SEQ ID NO: 10228 - DNA, 477 bp, Canis familiaris
actggactccgtcttgtttgacaaacaagaattccctgatccagagaagttcaagccagagcactttctgaatgaaaacggaaaattcaaatatagtgactacttcaaggcattctccgcaggaaagcgggtgtgtgttggagaaggcctggctcgcatggagctcttcctgttcttgtccgccattttgcagcactttaacctgaagtctctcgtcgaccccaaggatattgacctcagtccctgcacaatcgggtttgccaagatccccccccattacaaactctgtgtcgttccccgctcgggctgaagacccccgggccccaggctctttggtgcaaacctggagtcttcctgcttccgcatatccctttaatgcctccaggaagaccctccctgcacagtctggtggaggcactcagggtttcacagggaataaattggtcctgagatgctgcttttcagagtcacactcat

SEQ ID NO: 10229 - DNA, 71 bp, Canis familiaris
ggccgacaaaggtgagtgtgtccccggcgagcaggagccagagccttctccatacatgagagcccggcggg

SEQ ID NO: 10230 - DNA, 242 bp, Canis familiaris
tacatggaccagcaaggcattgacgtcttgtactcgggctcccagaaggtcctgaactcgcctccagggacgtccctcatctccttcagtgacaaggccaagagtaagatctacgctcggaagacgaagcccgtctccttctacctggacatgaagtggctggccaacatctggggctgcgacgaccagcccagtgtgtatcatcacaccaccccggtcatcagcctgtacagcctgaggga

SEQ ID NO: 10231 - DNA, 247 bp, Canis familiaris
gatactttcaagtccaagttccaagtgagcaagagcaggtcggtgaaagtgcccatgatgaaccttgaggacgtgtgggtgccttacttccgggacgacgcgctgtcctgcacagtagtggagctccagtacaccagcaacgacagtgcgctcttcgtcctccccgacgagggcagaatggaggcagtggaggccatgctgctcccagagacgctgaggaggtggacacactccctgcagatgagga

SEQ ID NO: 10232 - DNA, 553 bp, Canis familiaris
  misc_feature (218)..(218): n is a, c, g, or t
gggcgacagccacagctccgagaaagcctgctggaggagttcagggaggtcgccttgggtgtgggcatccccgcggacgctatcttcaccatggccgacaaaggtggatgctccccaccccacctcacatttctgtcccctcctcattcttcacagcccccagagaacgccttcccagcccctggcacccaggctggcaccgggcccaccgcgacacncagtcggtgctgccgccggccccccgcagatgcctgccagctggaccacgcggaaggcccctgcctggggatggtcaccaggtatttctacaacggctcctccatggcctgtgagaccttccagtacggcggctgcctgggcaacgggaacaacttcgcctccgagaaggagtgtctgcagacctgccgcaccgtggcggcctgcagcctccccatcgtccccggcccctgccgaatgcaccacagcctctgggcctacgacgccgtccagggcaggtgcgtccgcttcgtgtacgggggctgccaaggcaacggcaacaagttctactcggaga

SEQ ID NO: 10233 - DNA, 411 bp, Canis familiaris
aaagtcaatgtccagtttctccgttcgaacattgggattgtttcccaggaaccagtgttgtttgcctgtagcataatggacaatatcaagtatggagacaacaccagagaaattcccatggaaaaagtcatagaagccgcaaagcaagcacagctgcatgactttgtcatgtcactcccagagaaatatgaaactaatgttgggtcccaagggtctcaactatctcgaggagagaaacaacgtattgctattgctcgggccattgtacgaaatcctaaaatcttgctactagatgaagctacttctgccctagacacagaaagtgaaaagacggtgcaggttgccctggacaaagccagagaaggtcggacctgcattgtcatcgctcatcgtttgtctaccatccaaaac

SEQ ID NO: 10234 - DNA, 498 bp, Canis familiaris
aatcgctactgactacacggacaagaaccgcctagagctggaaaagtggctgaagaagatgccaggggcgtttgactggtccccagtggtgaaatatgtgtgtgagcttgagggggacagggacaagtgggctgagaaggaggagcggctaaggagaactgtccgccgggtactcaagtgtgacgttgggaaagaacggcccctggaacccgcagtcctgcccctggcggactgcctcctttcctctctatgtcttgagtccgcctgcggcaccctggaggccttccgagacgccctgcgccacctcaggcccctgctccggcccaggggccatctggtgctgaccgggagctttgactgcaccttctacatggtgggagactcgagattcactgtactgccactgaaggagaaggtcctgcgtgaagtcctgcaggagtccggcttcaccatcgagaggctggagaaggctcagcgaggacccgagaccgtcttgga

SEQ ID NO: 10235 - DNA, 84 bp, Canis familiaris
aggtgctggtgtggcccacggaatacagccactggatcaatgtaaagacaatcctggatgaacttgtccagaggggtcatgaag

SEQ ID NO: 10236 - DNA, 552 bp, Canis familiaris
tgcactcagtacatcagacacgggtccaaacctatgtatacacctgaacctgacatctgccatgagctgttgggacacgtgcccttgttttcagatcgtagctttgcccagttttcccaggaaattggccttgcttctcttggtgcacctgatgagtatattgagaaactcgccacaatttactggtttactgtggaatttggcctctgcaaacaaggagactccataaaagcatatggtgctggactcctatcatcttttggtgaattacagtactgcttgtctgacaagccaaagcttctccccctggagctggagaagacagccatccaggagtacactgtcacagagttccagcccctgtattacgtggctgagagttttaatgatgcaaaggagaaagtaaggaattttgctgctaccatcccacggcctttctcagttcgttatgacccatacactcaaagaattgaggtcttggacaatacgcagcaacttaaaattttggccgactccatcaacagtgaagttggaatcctttgtagtgccctc

SEQ ID NO: 10237 - DNA, 504 bp, Canis familiaris
  misc_feature (27)..(27): n is a, c, g, or t
tctccctttagctgaccttatttagancccttacctgcaaatgcttttagagcctcattatacatgattgccagataaataggggtacttatctcacacggagaggtttacaatatactccactaatggcccagggtcagggaaagaattggaccagagaaatgaggatatgcctcctctagttttgagggtgcctcggggtggcacagggtgacgaaggtagagtccctcaccatctcctaatttaggcatttggggactgctcaccttctgagctcattccccacctgcatcttcgcccctgctgagactgcagccccatcccatgaaatgaaaagaacagaggttttggcgtcggaagacatggactttggtacttggctcttagcttagttgctcttgtgatgtcaggtgtgttgttaataccacagagccttgtgtccccatctctgaaatggaaataataacccacctccccagggcagttgtgagaccccaaagaga

SEQ ID NO: 10238 - DNA, 334 bp, Canis familiaris
  misc_feature (202)..(202): n is a, c, g, or t
  misc_feature (236)..(236): n is a, c, g, or t
  misc_feature (240)..(240): n is a, c, g, or t
  misc_feature (282)..(282): n is a, c, g, or t
  misc_feature (295)..(295): n is a, c, g, or t
  misc_feature (298)..(298): n is a, c, g, or t
  misc_feature (301)..(301): n is a, c, g, or t
  misc_feature (305)..(305): n is a, c, g, or t
  misc_feature (309)..(309): n is a, c, g, or t
tagccctgctggcatgggttgttctggctgaccaagaatcatgcaagggccgctgcacagagggcttcaatgctgacaggaagtgtcagtgtgacgagctctgctcttactaccagagctgctgcgaggactacgtggccgagtgcaaaccccaagtgactcgtggggatgtattcgctctgccagaagatgagtatggggntcattgacgatcatgaggggaccagagaacagancgtnctcacacagctggagagtaccaccctgagccctggcctacangcccagtctgaanagnttnctgnccangtacctattctgatccctgaggaag

SEQ ID NO: 10239 - DNA, 232 bp, Canis familiaris
tcgtccaagtcaccagggcttctagtcagtgggtgtatggccctgcgtacttcgtggaatacttaatcaaagagtcaccatgtaccaaatcccaggtcagcagctgtgcacttcagccccctgactctgagcctgttggtatttgcaaaggttctctgggtcaaagagaattagaaaagttcgtctccgtgacttgtcacttctttgaaccacaggttcctgcacctggaga

SEQ ID NO: 10240 - DNA, 216 bp, Canis familiaris
aattagccagcttaccaacatgggacccacggaacttctgattgaaatggaggactggaaaggcgacaaggtgaaggccctctatggaggattcactatgcagaatgaggccaacaaataccaactctcagtgagcaaatataagggaacagctggcaatgccctcatagaaggagcttctcaactgtttggagagaaccaaaccatgaccatcca

SEQ ID NO: 10241 - DNA, 212 bp, Canis familiaris
ctgcagagcagatttgtcctatgatatagaagtctctgacttagaaagtccaaaagacattgccataaactgtgaagtcttcaactttgcggtgggttgcttaagtagtctttgtgatgagcagtgccagactaagaaatattttcacacacatagtgtgttttgttcctatggctctggggggtgtggtaaacaccaccattttggccatc

SEQ ID NO: 10242 - DNA, 573 bp, Canis familiaris
cctgctttctgcttatggttcataggccataatcgaatgtggagaaagaaccggtcctatcatgaaaataatcgttgcatcggaacagacctgaacaggaactttgcttccaaacactggtgtgaggaaggtgcatcaagtctctcatgctctgaaacctactgcggtccttaccctgagtcagaaccggaagtgaaggcaatggctaatttcttgagaaaaaacatcaaccacattaaggcttacatcagtatgcattcctactcccagcacatagtgtttccatattcctataatagaagcaaaagcaaagaccatgaggaactgtccctagtggccagtgaagcagtccgggctattgaaaatactaataaaaataccagatatactcatggcagtggttcagaaagtttatatctagctcctggaggttcagatgactggatctatgacttgggcataaaatactcgtttacgattgaacttcgagatacaggcagatatggattcttgctgccagagcgtttcatcaaacccacttgtgcagaagctctcgcagctatctctgaaata

SEQ ID NO: 10243 - DNA, 377 bp, Canis familiaris
ttttggcgatgaccctagtgataaattcttcacatcccacaatggcatgcagttcagtacttgggacaatgacaatgataagtatgaaggaaactgtgctgaacaggatggatctggttggtggatgaacaagtgtcatgctggccacctcaatggagtttattaccaaggtggcgtttactcaaaaacatctactcctaatggttatgataatggcattatttgggccacttggcaatcccggtggtattccatgaagaaaactaccatgaagataatcccattcaacagattaaccattggagaaggacagcagcaccaccttgggggagccaaacaggttggaccagaacaccatgttgaaatacactatgatt

SEQ ID NO: 10244 - DNA, 383 bp, Canis familiaris
actggaaccacagaattttggttgggaaatgagaagattcatttgataagcacacagtcggccataccatacgcattaagaatacagctggaggactggaacggcagaaccagtactgcagactatgccatgttcaaggtgggacctgaagctgacaaataccgcatgacgtatgcctactatattggtggagatgccggagatgcctttgatggctatgattttggcgatgaccctagtgataaattcttcacatcccacaatggcatgcagttcagtacttgggacaatgacaatgataagtatgaaggaaactgtgctgaacaggatggatctggttggtggatgaacaagtgtcatgctggccacctcaatggagttta

SEQ ID NO: 10245 - DNA, 448 bp, Canis familiaris
  misc_feature (49)..(49): n is a, c, g, or t
  misc_feature (57)..(57): n is a, c, g, or t
  misc_feature (62)..(62): n is a, c, g, or t
  misc_feature (68)..(68): n is a, c, g, or t
  misc_feature (71)..(71): n is a, c, g, or t
  misc_feature (74)..(74): n is a, c, g, or t
  misc_feature (77)..(77): n is a, c, g, or t
  misc_feature (88)..(88): n is a, c, g, or t
  misc_feature (90)..(90): n is a, c, g, or t
  misc_feature (161)..(161): n is a, c, g, or t
  misc_feature (212)..(212): n is a, c, g, or t
  misc_feature (226)..(226): n is a, c, g, or t
ttgcaaaggttctctgggtcaaagagaattagaaaagttcgtctccgtnacttgtcncttcntttganccncanggntcctgcacctngnagaggaaaatgcttctgctagccagggacctgtggacctccctggggtgggagagttccagcagaaaaacncagctcctaccaactcaccctccaaagctgtgcctaagggatctgtccaanatctccctgacttngatgatgagaagaagcctgagggtgctcaggaaaacagccctgtcgaggccttccctgtgaagctagatctcaccacagatcctcagggagaaagcctggatgtttccttccttttcctgggacctatggagcggaagctggttgttctgcctttccccaacaaagaacaacgctctgctgagtgcccaggaccagcgcagcagggcaaccttcttattctc

SEQ ID NO: 10246 - DNA, 389 bp, Canis familiaris
actcatcaccaacctgtcgtcagtgctaaaggacgagaaggtctggaagaagcccttccgcttctaccccgagcacttcctggacgcccagggccacttcgtcaagcatgaggccttcatgcccttctctgcaggccgccgcgtctgcctcggggagcccctggcccgcatggagctcttcctcttcttcacctgcctcctgcagcgcttcagcttttcagtgcctgcggggcagccccggcccagcgaccacggggtcttcaccttcctgaaggttccagcccccttccagctctgtgtggagcctcgctaggggcaggaaccaccaccccccgccgcccggctcctcagcaggggcccgaggtacaataaaccagtttggtggctcc

SEQ ID NO: 10247 - DNA, 140 bp, Canis familiaris
atgtcacccgattcaaggacacctactttgtcactggcattgtcagctggggagaaggatgtgctcggaaggggaagtatgggatctacaccaaggtcaccaacttcctcaagtggatcgataggtccatgaaagctagg

SEQ ID NO: 10248 - DNA, 355 bp, Canis familiaris
  misc_feature (26)..(26): n is a, c, g, or t
  misc_feature (39)..(39): n is a, c, g, or t
  misc_feature (97)..(98): n is a, c, g, or t
  misc_feature (113)..(113): n is a, c, g, or t
  misc_feature (120)..(121): n is a, c, g, or t
  misc_feature (128)..(128): n is a, c, g, or t
  misc_feature (130)..(130): n is a, c, g, or t
  misc_feature (199)..(199): n is a, c, g, or t
  misc_feature (215)..(215): n is a, c, g, or t
  misc_feature (228)..(228): n is a, c, g, or t
  misc_feature (242)..(242): n is a, c, g, or t
  misc_feature (260)..(260): n is a, c, g, or t
  misc_feature (271)..(271): n is a, c, g, or t
  misc_feature (274)..(274): n is a, c, g, or t
  misc_feature (280)..(280): n is a, c, g, or t
  misc_feature (295)..(295): n is a, c, g, or t
aaaaaggagtagtcgtatctgaggcntccagctggtctncctcctagacgggctcctccggtttctgccagcaaggagttatgatgcaaagttcccnnccctgtgaagaaacnactcctnncaacttngnttctgagatcaacatctgctctcaagggatttattgcctgtttaagagtcagaaatatgtcatgccaanagaaaaactggcaaantaaaattaaattnaaataaaactctangggaatttacagaaactnattattctaantgnaaagtnatccccctccaaaanttactgagcttacctgtgtttccaacattgggcatgaatatcagaacattaagtaggcta

SEQ ID NO: 10249 - DNA, 111 bp, Canis familiaris
gatcatgcacacatggatcttcagctaagaattgcttctttctcgcagaagtgtgaactctttccaggggaagattttgtacaaccaccttccaggatttgccttggctgc

SEQ ID NO: 10250 - DNA, 107 bp, Canis familiaris
ccttggtcatggaggtcaacgggaacttgactttgatcttgaacaccaaaggagacatggccttggccatggacatcaaaggggacatggcttagcccatggacata

SEQ ID NO: 10251 - DNA, 565 bp, Canis familiaris
tcaaaagcaacatggccttggtcatggaggtcaacgggaacttgactttgatcttgaacaccaaaggagacatggccttggccatggacatcaaaggggacatggcttagcccatggacataaatatgagcatggtcatggccatgaaaaatataaaaataaaagaaaagacaatggaaagaacaatggtcggaaaacagagaatttggcaggttctcctgaagatagtactacctcttctgcacagacacaagagaagacacaagggccaacaaccctcccttccctagcccagccaggtattgcagttaccatgcctgactttcaggactcagatctctttgcagctgtgatgcctaacataccaccaactgccacagagagtgatgatgattggatccctgacatccagataaagccaaacagcctttcatttaacctgatatctgacttcccagaacaaacctcccccaaatgtcctggacgcccctggaagccagttcatggaatgaatccaactgtggaagtgaaagaatttcatgatttcgatctctctgatgctttg

SEQ ID NO: 10252 - DNA, 484 bp, Canis familiaris
ggatgtacagagatgcctcgggtttaatctggatttttctctggaagctggagttgaaatcagtggaaagcttaataaagatgattgtttaaagaggggtgaaggtgaaactgtaaacatcagtagtgatggcatcattgatgatgttatttcactgataagaggaggaacccaaaaatatgcatatgaactgaaagagaagcttctcaaaggagccaagacaattgatataactgactttacaaattgggccacttccttaaatgatgctccagtgctcataaatcacaaactatctcctatatataatctgattccagtgcaaataaaagatgcacacctaaagaaacaaaatttggaaagtgccattgaagattacatcaatgaattcagtgtgagaaaatgcgaccagtgcaaaaatggaggtaccataattctgctagagggagaatgtctgtgttcctgcccaatcgaatttacgggc

SEQ ID NO: 10253 - DNA, 368 bp, Canis familiaris
  misc_feature (26)..(26): n is a, c, g, or t
  misc_feature (55)..(55): n is a, c, g, or t
gtcctgaaccggttgtgtgtgttgcncgagaagaccccagtgagcgagagagttnccaaatgctgctcagagtccttggtgaacagacgaccatgcttttctggtctggaagtcgatgagacctatgttcccaaagagtttaatgctgaaacattcactttccatgcagatttatgcacacttcctgaggctgagaaacaagtcaagaaacaaactgcacttgttgaactgctgaaacacaagcccaaggcaacagatgaacaactgaaaactgttatgggagattttggagcctttgtagagaagtgctgcgcagctgaaaataaagagggctgcttttctgaagagggtccaaaactcgttgctgc

SEQ ID NO: 10254 - DNA, 325 bp, Canis familiaris
  misc_feature (287)..(287): n is a, c, g, or t
tgtgctggtctctggctgttgcccaccctctttctccggacggtacccatgggaatggaactgaaggtgggagtggggccagagtgaagccagatgtgaccgaactctgcttggatggctggagctttgatgctaccaccctggatgaacatggggccatgctgttttttaaaggggagtttgtgtggaagagtcacagatgggtccgggagctaatctcagagaggtggaggaatttaaccagccccgtggatgcggccttccgccgtggtcacaacagtgtcttnctgctcaagggagacaaagtctgggtgtatcctcctga

SEQ ID NO: 10255 - DNA, 374 bp, Canis familiaris
  misc_feature (260)..(260): n is a, c, g, or t
  misc_feature (275)..(275): n is a, c, g, or t
  misc_feature (317)..(317): n is a, c, g, or t
  misc_feature (334)..(334): n is a, c, g, or t
  misc_feature (343)..(343): n is a, c, g, or t
aaggactctagttcattgacaacgaatataatggaacttgtgagaggggattttgccactgccaacaataatgataatacatatagccaagtgtcagaagatctgagaagcaaaattgagatcctgaggcgcaaagtcctagaacaagtacaacacatccaccttctacagaaaaatgtcagggatcagctggtagatatgaaacgactagaggtggacattgatattaagatccgatcttgccaagggtcatgcagtanggctttagagcgtangacagatctaaagtactatgaagatcaacagaagcaacttgnacaagtcattgccaaanacttacttncacctaaagacaggcaatacttaccactgct

SEQ ID NO: 10256 - DNA, 52 bp, Canis familiaris
aagacacacgctaatgcatgcccggagtcaataaagacatggctcccacaga

SEQ ID NO: 10257 - DNA, 426 bp, Canis familiaris
ttggcatctactgcatccagttcatctctatggtctttggtgggcagaagccggagaagatttcagccgtgggaaggcgctatgaaacaggtgtggacgacaccgtcactgtgctcctccagtacccaggagggatccatggcagctttacctgcagcatctctgctcagctctctaatatggcctttgtgagcggtaccaagggcataggccagatccttgacccttgctggtgcccaacggagctggtgttgaagggagagcataaggagttcccactgcccccggccccaagcaaggagttcaattttacaaatggagcaggcatggcttatgaggccaagcatgtccgggagtgcctgcgaaagggcctgaaggaaagtcctgtgattcccctggcagaaagtgaactcctggctgacatcc

SEQ ID NO: 10258 - DNA, 138 bp, Canis familiaris
gacaaatttcttcctgaacgtgccttggcagctataaatcatttacagaacattcaatttgaagcagtgattggccacaaaaccagaatgaaatgaataattaatgtcccaccagagatgtatgcaccttaatgatgt

SEQ ID NO: 10259 - DNA, 567 bp, Canis familiaris
  misc_feature (202)..(202): n is a, c, g, or t
  misc_feature (526)..(526): n is a, c, g, or t
ggtctagtccgtgaactcagctgggaaacgtcactggtaaaaatgactgaagagcccataaaggagatcctgggaaccccaaagtcttccaagccactgacaatggagaagagccccaccagcgaagtggtggtcaccacagtccccttggtcagtgagattcagttgacggctgctacagggggtgctgagctctcctgtnaccgctgcatcatccccttcgccgtggtggtcctcatcgctgggatagtagtcactgctgtggcttacagcttcaattcccacggctccatcatctccatcttgggtctggtcctcctgtcttctggactgtttctgttagcttccagtgccctgtgctggaaggtgaggcagaggagcaagaaagccaagagacgggagagtcagacggctcttgtggcaaatcagagaagcttgtttgcttaagactgaatgagaccaaatgggatatgtggcctgaaaatctccctctcactgtgtcgtccaattcacccagaactagggntgggagagaatgaacagtgcattgcagcagaccagagggat

SEQ ID NO: 10260 - DNA, 530 bp, Canis familiaris
  misc_feature (215)..(215): n is a, c, g, or t
taatgggatgactggagcccctggtgttgctggagagcgtggagaaaagggagagcctggcgagaggggccccccaggacttccagcttctttagatgaagagctccaaaccacactccacgacctcagacatcaaatcctgcagaccatgggagtcctcagcttgcacgagtccctgctggtggtgggaaggaaggtcttctccagcaatgggnagtccattaatttcaacgacattcaagagttatgtgccggggcaggcggccaaattgctgccccgatgagcccagaagagaatgaagccattgcaagcattgtgaagaagtataacacttacgcctacctgggcctggtggagagccccgactctggagacttccagtacatggatggggcccctgtgaattacaccaactggtaccccggggagcccagaggtcggggcaaagagcagtgtgtggagatgtacacagatgggcagtggaataacaaaaactgcctgcagtaccgactggccatctgtgagtttt

SEQ ID NO: 10261 - DNA, 553 bp, Canis familiaris
ccagtcggagctgatggtgaccccagcccagggaggagctccccaccccaccttctcctgtagcttcagccctggccttccccggcgtcgagccctacatgcggcccccatccagctcaacgtctgggagtctgtgcctctggaagtccaagtgatggtagagccaggtggaatgctagctcctggtggtactgtgaccctgacctgtgaaactcctgcccaatcctctgttcaaatcctctctgaggtgaagcctgaggaccaaggaacctacagctgtgtggccatgcatcccagccacgggtcccaggaaagccgtggtgtcagtgtcgtcattgaaactgacaaagaggggccaaccacaggctatgtggaagggcaggggctgggaactgtcgccctggccctggggatcctaggaggcctggggatagctgtcctgctcatcggggccatcatgtggcgaagacggcaacgccaaagacaggagaggaaggccccagaaaaccaggaggaggaggaggaggaggagcgcacagagctgaatcagtca

SEQ ID NO: 10262 - DNA, 532 bp, Canis familiaris
aggaggtcttgatcgagagcccgccggactactcagcagctccccggggccggttgggcatcccctgcttcccttcgtccctcaaacgcctgctcatcatcgtagtagtgatagtccttgtggtcgtggtgattgtcggcgctctgctaatgggtcttcacatgagccagaaacacactgagatggtcctagagatgagcatgggggggccagaagcccagcagcgcctggccctgcaggagcgtgtgggcaccactgccaccttctccattggctccactggcatcgtagtgtatgactaccagcggctcctgattgcctataagccagccccgggaacctgttgctacatcatgaagatgactccagagaacatcccaagtcttgaggctctcactagaaagtttcaggacttccaggtaggtgtcaagccagccgtgtctacctctaagctgggacaggaggagggccatgatgctggctcagcatcccctggggatcctctggacttcctgggcaccacagtgagcac

SEQ ID NO: 10263 - DNA, 326 bp, Canis familiaris
gaaggtaaccatcgacagtggctacgacgtggcgcagatctcccgacacctggacttcatcagccttatgagctatgactttcacggagcctggcgtcagaccaccggacaccacagccccctgttccgaggccagatggatgcaagttctgaccgattcaacaatgctgactatgccgtgagctacatgctgaggctgggggtcccagccaataagctgctgatgggcatccccacctttggaaggagcttcactctggcctcctctgagaccggtgtgggtgcccccatctcagggccgggattatcaggccagttcaccaagg

SEQ ID NO: 10264 - DNA, 522 bp, Canis familiaris
  misc_feature (43)..(43): n is a, c, g, or t
  misc_feature (57)..(57): n is a, c, g, or t
  misc_feature (94)..(94): n is a, c, g, or t
  misc_feature (174)..(174): n is a, c, g, or t
  misc_feature (270)..(270): n is a, c, g, or t
acatctggtcggtgtctccatgaggtcagagggccggctggtnccgcagcatggtgnaggccggcctaccctaatcattggcatgtaccatccnctgccttgagtctcaggttgcctctcatctcctgacctaaaagcagccagtctacaccctagggaagatctcacccccancctcagacataatccaagtaatttcctgctgatagacatgtccccacaccaatccggatctcagtgaggtgttcacatccctcaccccaccactgnctgtttactgagcacgtaaatagcgtaagtgccccaattctatgtacgcagaaccttgccaacactcctaatacattttatggaatatgattcatctttacacaatgccatgggcccagcctgattttccccattcttatgtgaggacccaaacttaaagaagttaaatgttttgaattttattccttggagcaagtggcagaggctgtgttcaaacctatctgcctggacctgaagctcatgctcataacc

SEQ ID NO: 10265 - DNA, 352 bp, Canis familiaris
  misc_feature (28)..(29): n is a, c, g, or t
  misc_feature (79)..(79): n is a, c, g, or t
agctcagctccggtgcacaagcgggtannaggggggccctgggcagctggggcctggggagggcagagcgcgggacacnagctcagcaaccccttcggattcgtgaaaatgctcgatggccccagccccacacggaggtgccttcgaccccctccccaggcgtccttgccaaagaaggccatttggccagtgctgccccacgcagccaagcacgtcccacgaagcagccgccgcacgaatcgccctctcagggcccaacttgaaaccctgcggccaggaacatgaccatgtcccaccacttccccttcctaattccgcagccgcggctcaataaagcaccagggctttcgcg

SEQ ID NO: 10266 - DNA, 189 bp, Canis familiaris
tcttctacatctaggacccctcaggacccacggaggccccaggtgaggagggaagatccacgctcaaagggtctttggcagagacgcgggaagctgctcctgcccacaccacggggaccagcgctggcgaaatgggagctgtggggagaggtgggagcgggcaggagctgcggctcctgggcacacggg

SEQ ID NO: 10267 - DNA, 243 bp, Canis familiaris
tgaagctcgctgtcatccttgccctggtcaccctggctctctactgcagccctgcttctgcagagatctgccagaactttctaaatgtcatcaaagccctcttcctggacacgccttccagttaccaggctgcacttgaatttttcaacccagacgcagacatgaaagatgcaatgatccagctgaagagtctggtggacaccctcccctcaaacaccaccgagaacatcctaaagttcacgg

SEQ ID NO: 10268 - DNA, 597 bp, Canis familiaris
  misc_feature (298)..(298): n is a, c, g, or t
  misc_feature (484)..(484): n is a, c, g, or t
acacaggatctctctgagcagcagttgcccatccccctcccatactgctggctctgcaggactctgatcaagcggatccaagctatgattcccaagggtgtgctggctgtgactgtgggccaggtgtgccacgtcgtacccctggtggtgggcggcatctgccagtgtctggccgagcgctacactgtcctgctcctggatgcgctgctgggccgcatgctgccccagctggtctgcggcctcgtcctccggtgctcccacgaggacagcgctgggccagttttctctctattcctcncagctctggcgtctctgcccagtgaatggtcaccccaagagtccaagtgccagctctgcatgtttgtaaccacccaggcagggaaccacagtgagcaggccacaccacaggcaatacgccaggcctgcctcagctcctggctggacagacagaagtgcgagcagtttgtggagcagcacatgcctnagctgcagaccctagcatccgggggcagggatgcccacaccacctgccaggccctgggggcgtgtaggaccacgttcagtcctctccagtgtatccacattcctcacttctga

SEQ ID NO: 10269 - DNA, 202 bp, Canis familiaris
ccaagaagcggctgacgctgagcgagatctgcgagttcatcagcggccgcttcccctactaccgggagaagttccccgcctggcagaacagcatccgccacaacctctcgctcaacgactgcttcgtcaagatcccccgcgagccgggcaacccgggcaagggcaactactggacgctggaccccgagtcggccgacatgtt

SEQ ID NO: 10270 - DNA, 106 bp, Canis familiaris
gcagcagttgctgagatccagccttctccaggccctgcattgcggcgacgggtatgggaacctcttcaccactaactccatctgcaaggctcaataaagacaaaat

SEQ ID NO: 10271 - DNA, 310 bp, Canis familiaris
gtaagtgtacttttgctctttaatataggctttaatcactagtacgatgatcataaaatttgtagatattagatttaacccagctacagcaggcctatattaatttcaattctaccttggaatgtggtgacatatataaaaattctagcaattattctgtggttaaaaacattgtataggctctgagttagtagttgtttgagttaagctattttctgataaaagtttaaagatatctggtggttagttgcttgaatttctctgaataaatggcctaacaaggtaagatggttgaacctatggaaaccta

SEQ ID NO: 10272 - DNA, 276 bp, Canis familiaris
cctctgctgtctgccatgaagggaagcagcaccctcctgctggtggccctctccttgctctgctcctgcgggctggcctctgacgaggacagcagtgagtttttcatggacttcctgcaaacgctgctggtggggtccccagaggagctgtacgaggggcccctgggcaagtacgacgtcaatgcagatgccaaagcggcgctgactgagctcaagtcctgcatagacggcctacagcccatgcacaaggcggagctggtcaagctactggtgcaa

SEQ ID NO: 10273 - DNA, 437 bp, Canis familiaris
gaataaggctgtagcccgtttgttaaaaaaaaaaaagtcttctatgtggctacagagttttgagtctattttacgaatatctcagcctaacaaatttgtaatgtcctcatgaataatgtgcatttagtttctttattatagagtaacctccttacatatgattaggtattcaaactcttctagtaaaacaggtttctactagtattttccctgagctagaggcggtcttagagcgtaaggtaatataatttatcccttttcattgcgatttaatattataaatatcaaatattaaaattaaaatggacactttaaaacttgagtatgctggtatcttgtatctttgcttgagtaggattgtcttatcaaagaagtgttcttatttaagtatatcatttgtttgttaatatattaaagtgtgactactctccctggaa

SEQ ID NO: 10274 - DNA, 35 bp, Canis familiaris
accgaggcctgcctgtctgtgtttttgtccaggtt

SEQ ID NO: 10275 - DNA, 145 bp, Canis familiaris
actgtaaccttaaggtgaacggatgtaacaagatctataatcctatctgcgggagtgatggaattacctatgctaatgaatgcttgctatgtcttgaaaataagaaacgacaaacctctatcttggttgaaaaatctgggccttg

SEQ ID NO: 10276 - DNA, 511 bp, Canis familiaris
gacttcgtcttcatgtttctcttcgggggcgtcctcatgaccgtatccttcccggcgctgaaacttcaggccgcagcgcctctgggcccagcctgtgttggccatggggccgacatgggcaccccggccggagggggacagggcggccctcacagtcatgctggtgtatgtgtggagccgccgcaacccccgagtgagggtcaacttctttggcctcctcaccttccatgcaccattcctgccctgggcgctcatgggtttctcactgctgctgggcaactcgattctcgtggacctgctggggattgcggtgggccacatttactacttcctagaggatgtcttccccaaccagcctggaggcaagaggctgctgctgaccccccgcttcctgtgagtgctagagatgactccccttaccctccctcagatggctccctgcccgggaccgttgctggcctcagctcagtgcaggcccctccctacaggaagctgctactggatgccccac

SEQ ID NO: 10277 - DNA, 418 bp, Canis familiaris
  misc_feature (29)..(29): n is a, c, g, or t
cctgcaggacaaaatggcttgggattgtnggggggttccctcatcagccagtcctgggtggtcactgctgcccactgcaatgtcatccctggccgtcacgttgttgtcctgggagagtacgaccgatcatccaatgctgagcctttgcaggttctgtccatctcaaaggccatcacgtacccttcctggaaccccaccaccttaaacaatgacctgacgctactgaagctcgcctccccagcccggtacactcaacgcatctcaccagtctgcctggcttccccagatgaggagctgcctgcaggcctcaagtgtgccaccactggctggggacgcctcagcggcgtgggtaggaatttgggccagagatctgggtaatgtggctaagatgggaacaagtcatccagggccgaactac

SEQ ID NO: 10278 - DNA, 465 bp, Canis familiaris
  misc_feature (383)..(383): n is a, c, g, or t
atcagccagtcctgggtggtcactgctgcccactgcaatgtcatccctggccgtcacgttgttgtcctgggagagtacgaccgatcatccaatgctgagcctttgcaggttctgtccatctcaaaggccatcacgtacccttcctggaaccccaccaccttaaacaatgacctgacgctactgaagctcgcctccccagcccggtacactcaacgcatctcaccagtctgcctggcttccccagatgaggagctgcctgcaggcctcaagtgtgccaccactggctggggacgcctcagcggcgtgggtaggaatttgggccagagatctgggtaatgtggctaagatgggaacaagtcatccagggccgaactacccccttntggtctacaggcaatgtgaccccagcacgtctacagcaggtggctctgcctctggtcaccgtgaatgagtgcaggcagtact

SEQ ID NO: 10279 - DNA, 126 bp, Canis familiaris
ccactgcaatgtcatgtgagtactcccactctacccgccccctcagcccacttgtccccacctcgttcccctggatgcccctcttgtaactctgccctccctgtggctgcacaaccccactctgac

SEQ ID NO: 10280 - DNA, 221 bp, Canis familiaris
  misc_feature (41)..(41): n is a, c, g, or t
  misc_feature (46)..(46): n is a, c, g, or t
  misc_feature (48)..(48): n is a, c, g, or t
  misc_feature (51)..(51): n is a, c, g, or t
aagtggcttccacttctgtggtggttccctcatcagccagncctgngnggncactgctgcccactgcaatgtcatgtgagtactcccactctacccgccccctcagcccacttgtccccacctcgttcccctggatgcccctcttgtaactctgccctccctgtggctgcacaaccccactctgactgcagccctggccgtcacgttgttgtcctgggaga

SEQ ID NO: 10281 - DNA, 46 bp, Canis familiaris
agaactccgagctgctgcttactatttttattttcaggaagaggag

SEQ ID NO: 10282 - DNA, 293 bp, Canis familiaris
acagggactttcaagacacagcagtgggacttccgcaggcaggatttcctcgaatctgctccgggcctggggatgtttgtgactgtcacaacctacaacgatgaggtattattgtccaagttatatggcccacaaggaagattctattttacttcacattcacctggcgaacacatcatttgcttggaatctaattctacgaggcttgtgtccttcggtgggagtaagctgcggatccacttagagattcgagttggacaacatgaccttgatgcggccattgctcaagcaaa

SEQ ID NO: 10283 - DNA, 471 bp, Canis familiaris
aatgaaattcctcgtactggctgctctgctcacagtggccgctgccgaggggggcatcagcccgcgggcagtttggcagttccgcaacatgatcaagtgcacgatccccgagagtgaccccttgaaggactacaacgactacggctgctactgtggcctgggtggatccggcacccctgtggatgagttggacaagtgttgccagacgcatgaccactgctactcagaagccaagaaactggacagctgtaaattcctcctggacaacccctacaccaaaatctactcatactcatgctccggctctgagatcacctgcagcagcaaaaacaaagactgccaggcctttatctgcaactgtgaccgcagtgctgccatctgcttttcaaaggctccgtataacaaggagcacaagaacctggacactaagaagtactgctagaattgagtctcctctctggaaagcatcat

SEQ ID NO: 10284 - DNA, 200 bp, Canis familiaris
tgctgctcctgtcagcctgtgtggctctgttgctgcagccgccactgggtacccggggggccccgctggagccagtgtatccgggggacgatgccacaccagagcagatggcccagtacgcggctgagctccgcagatacatcaacatgctgaccaggcccaggtatgggaaaagagacagaggagaaatgcgggacatc

SEQ ID NO: 10285 - DNA, 475 bp, Canis familiaris
ttccctgtccagtggccatgtgatggtgaacgggacccggaaacaagtgctgctcgttggagccccgactcatgatgaggtgtccaaaatggcattcctgaccatgaccttgcaccaaggtgggaccactcggatgtacgaactgaccctcaacgcacagcctgctctgctcaccaccttcagtggggaccgccgcttctctcgatttggtggagttctgcacctgagcgacctggatggtgatggcttagatgaaatcattgtgggagccccactgagaataacagatgtcacctctggactgatggggggagaagatggtcgtgtttatgtttataatggcaaacatatcacctttggtgacatgacaggcaaatgcaaatcatggacagctccatgtcctgaagaaaaggcccagtacgtactggtttctcctgaggcaagttcaagatttgggagctctgtgatcaccgtg

SEQ ID NO: 10286 - DNA, 556 bp, Canis familiaris
atcatcggagacgtctacagcaccggcctcgccatgcaggctctctctgtgacacctgagccacctaacaaggagtgggactgcaagaagaccatggacacgatacttaaggagattgagcaggggaagttccacaatcccatgtccattgcccaaatccttccttccctgaaaggcaagacatacctggatgtgccctatgtgtcctgcagccctggtcatcaagtgcaacccactctccccagtcaacccagccccgttcccacctcggcatccaacatcaccgtcgcgtacaccataaataaccagctgaagggggtggagctggtcttcaatgaaaccatcgatgttagcgtgaaggatggatccgtgctcctcgttgtcctagaggaagcacaacgcagaaatcccatgttcaaatttgtaaccacgatgacatcctggggccttgtcgtgtcctctatcaacaatattgctgaaagtgtccatgacaggacatactggcaattcctgagtggcaaaacacctttgaatgaaggagttgccgactacaccc

SEQ ID NO: 10287 - DNA, 489 bp, Canis familiaris
aagaaaggcgtttggctcactgacctggtgcacgtggcggcccatgagattggccatgcgctgggcctgatgcactcacagcatggccgggcgctcatgcaccttaatgccactctgcgtggctggaagaccctgtcgcaggatgaactgtgggggctgcaccgactctatggctgcctagaccggctgttcgtgtgcacatcctgggctcggaggggattttgtgacacccgccggaggctcatgaagaggctctgccccagcagctgtgacttctgctatgagttccccttccccacggtggccgccactgcaccaccacccaggaccaagaccaggctggtgcctgagggtcggaatgtgaccttccgatgtggccagaagatccttcacaagaaaggcaaagtgtactggtacaaggaccaggaacccctggagttctcctaccctggctacctggcgctgggcgaagcacatctgagcatcatt

SEQ ID NO: 10288 - DNA, 119 bp, Canis familiaris
gtcacctgtggacaggccccttttatagctctaccaccccacctggctctgtctactgccacctgacctgccagctgctacctataccggctgtccccatccgtcatggaaaagatcct

SEQ ID NO: 10289 - DNA, 422 bp, Canis familiaris
atggaaaagatcctcgtccttctgctcgttgcccttgcggtggtctacgcggttcctgaccctcgggggatcattatccacctggaagacggcgagctctgtctgaacagcgtccagtgcaagagcaagtgctgccaccgggccaccgggctgagcctggcccgctgcgcacccaaggccagcgagaacagcgagtgctctgccaagacgctctatggggtttactacaagtgtccctgtgagcggggcctgacctgtgagggtgacaagtccatcgtgggctccatcaccaataccaactttggtgtctgccacgatgctgggcgctccaagaagtaaagccactgaaggatgctcctcatccaccacctctccctggctggccacccccttaaccagcacctcccttttctgattggatt

SEQ ID NO: 10290 - DNA, 544 bp, Canis familiaris
ctacaagtcccgcatccaagtgagactcggagagtacaacatcgatgtcctggaggggaatgagcagttcatcaactccgccaaggtcatccgccatcccaactataacagctggatcctggacaatgacatcatgctcatcaagctctcctcacctgcggtcctcaatgcccgggtggccaccatatctctgcccagggcctgcgcagcccctggcacccagtgcctcatctccggctggggcaacaccctgagctctggcaccaactaccccgagctgctgcagtgcctggacgccccaatcctgactcaggcccagtgcgaagcctcctaccccggccagatcacggagaacatgatttgcgccggcttcctcgagggaggcaaggactcctgccagggtgactctggtggcccagtggtctgcaatggagagctccagggaatcgtctcctggggctacggctgtgcccagaagaacaaacctggagtctacaccaaggtgtgcaacttcgtagactggattcagtcgaccatagctgcc

SEQ ID NO: 10291 - DNA, 276 bp, Canis familiaris
gagcaggattctatcgctggaacaattacatgatggactggaaaaatcaatttaacgattatactagcaagaaagaaagctgtgcgggtctctaattaatagatttaccctttatagaatgttcgttttcctgtagatcaaggtaaaaatatcagtagctctcttacacacctcataagaaagctattatacagctgaaacaaaaatgccagaaggataatatcgattcctcacatcttccacttagtattgtacctagcatttcaaaatccaaat

SEQ ID NO: 10292 - DNA, 321 bp, Canis familiaris
ttttgagacctcagctgggcatctggccttgaagcttgcattcttccctttggtgatggcttccagtcacccatcggcaatgccagttctctctccaaatcatggaaaccatcttggtgttcatagactccgggccaggctaggtttggggaaagggaagagctttgccttgttcaacacactctgtgcttttatattcctctttctttcatggtggggggccctgttggcctgtcttggcctgacttcttcatttattaccaggatcctggggtcagacttgttccgtgcctctgtagctccagcctttaccagaaatgt

SEQ ID NO: 10293 - DNA, 566 bp, Canis familiaris
  misc_feature (57)..(57): n is a, c, g, or t
tcttttgtctgtaaactttggtccaattgtggatggggattttctcactgacatgcncgacacactactccaacttggacagttcaaaaaagcccagatcttggtgggtgttaacaaagatgaagggacagcatttttagtatatcgtgctcctggtttcagcaaagataacgacagtatcataactagaaaagaatttcaagaaggcttaaaaatgtattttccaggagtgagtgaatttggaagggaatcgatccttttttattatgtagacttgttagatgatcagagggatgaaaagtaccgtgacgcattggatgatgttcttggcgattacaatatcatatgccctgccttggaaagagctaattacacaaaagctgaggaaattttgagtagatccataatgaaatactgggcaacttttgcaaaatatggacatccagatggaacccagaacaatagcacaagatggcctgcctttgaaaacactgaccaaaaatatttaaccttgaatacagattcaccacgagtatacactaaactgcgtgctcaacaatgccgat

SEQ ID NO: 10294 - DNA, 89 bp, Canis familiaris
  misc_feature (50)..(50): n is a, c, g, or t
cacgtctgtcgctgctgtcagctgacctctggggggacatttgggaacanaccatttaaataagttctgagtgtttccaggcttttggg

SEQ ID NO: 10295 - DNA, 95 bp, Canis familiaris
gctgccaactaagcatgcgaccttgtgtaccactctatgcgccatcccctgttggccaattgcatcttccaactatgcttgagaacagtatctaa

SEQ ID NO: 10296 - DNA, 417 bp, Canis familiaris
  misc_feature (202)..(202): n is a, c, g, or t
  misc_feature (281)..(281): n is a, c, g, or t
  misc_feature (296)..(296): n is a, c, g, or t
  misc_feature (331)..(331): n is a, c, g, or t
  misc_feature (344)..(344): n is a, c, g, or t
atgctgatcaaactgagctctcctgccaccctcaactctcgagtgtctgctatcgctctgccaaaatcctgtccagctgctggtacccagtgcctcatctctggctggggaaatacccagagcatcgggcaaaactatcctgatgtcctgcagtgtctgaaggctcccatcctttctgacagcgtttgccgtaatgcatacnctggccagatctccagcaacatgatgtgtttgggctacatggagggtggaaaggactcttgccagggtgactctggtgngccctgtggtctgcnaacggagagctccagggcgttgtctcctggggtgnccggctgtgctcnaaaaaggcaaacctggtgtctacaccagggtctgcaaatacgtgagctggattcagcagaccatcgctgccaa

SEQ ID NO: 10297 - DNA, 426 bp, Canis familiaris
  misc_feature (169)..(169): n is a, c, g, or t
  misc_feature (171)..(171): n is a, c, g, or t
gaagaacaacctggtcgtggaagatgaggaaggctccgtgtttgcaaacgtggagtccatcgtcgtccacgagaagtggaactccttcctggtgcgcaacgacattgccctcatcaagctggcggagcctgtgcagctgagtgacaccatcaaggtggcctgcctgccngnaggcgggctccttgctgcctcaggactacccctgctacgtcactggctggggccgcctctggaccaacggccccattgccgacgagctgcagcagggcctgcagcccatagtggatcacgccacctgcacccagagagactggtggggaaccatggtgaaggacacgatggtgtgtgccgggggcgacggcatcatctcatcttgcaacggggactcgggcggcccgctcaactgccaggccgagaacggcacgt

SEQ ID NO: 10298 - DNA, 54 bp, Canis familiaris
cttaccccatgttaagagtcacagacctgtgaccaccgcatatcttactactaa

SEQ ID NO: 10299 - DNA, 529 bp, Canis familiaris
agacctgaccgcgtgtccgtgctggacagctaccagtacgacgacggctgcgagccctgcgggaatgacaccttcagccgcgagcctgccatcgtcaggttccactccccgctcacggaggtcaaggagttcgctgtcgtgcccctgcatgcagccccgctggacgcggtggcggagatagacgcgctctatgacgtctacctggatgtccagcacaagtgggacctggaggacatcgtgctcatgggcgacttcaacgccggctgcagctacgtggctgcctcccagtggtcctctatccgcctgcgcacaaacccggccttccagtggctgattcccgacaccgcggacaccacgtccacatccacgcactgtgcctatgacaggatcgtggtggcaggaagtcagctgcagcacgccgttgtgcctgaatcagccgcccccttcaacttccaggtggcctacggcctcagcagccagctggcccaggccatcagtgaccactaccccgtggaggtgacgctcaaga

SEQ ID NO: 10300 - DNA, 525 bp, Canis familiaris
  misc_feature (136)..(136): n is a, c, g, or t
gcgaatcactgctcatcaaatcctaaaatggttctctgagatgcaagaagaggaagtggaagtaagcctccctagatttaaagtagaacaaaaattagacttcaaagaagctttgtattctttgaatatgaccganatatttagtggtggctgtgacctttctggaataacagattcagctgaagtgtttgtttcccaggtcatgcaacacattttttttgaaataaatgaagatggcagtgaagctgcaacagcaactggtatgcacatccctgcaatcatgagtctggctcacaatcaatttatagcaaaccatccatttctgtttattgtgaagaataacccaacagaatcaattttgtttatgggaagggtgacaaatcctgacacccaaaagatgaagggaagagatttagattcactgtgattgaaaagaacagcctcagaatggaagatgattcctgaaaaatagtcgattggcaaaatatcatcatcttgcaaatattctctacatctctttttctg

SEQ ID NO: 10301 - DNA, 585 bp, Canis familiaris
tcgccttactttgacgacgaggacttcttcaccgaccagtcctcccgggaccccctggaggacggcgaggagctgctggccgacgagcacgccgaggtggagttcctcagccaccagctgcacgagtactgctgccgcgacggggcgtgcctgctgctgccgcccgcgccctcggccgccccaaggcgtgcgtccccgacggacctgcagctccagggattccggggagggggcgctggggggctaggggagtggaggaagagggttcgttctgacggtaacccgagacgcccgtcccgccgcggcgcccaggaggggatcctaaaggaccggagggcaccgctgggaatagagttggacgttcacggtctgttttctcttctcacctcctcagggtccccctcccccagcgacccggattacggcctccctccccttgcaggacattccctctcatggactgatgaaaagcaactcaaagaacaaaatattatccgaacagccaaagtgtggaccccagaggaccccagaaaactcaacagcaaatcttccttcaacaacatagaaaacgaaccgccctttgag

SEQ ID NO: 10302 - DNA, 82 bp, Canis familiaris
gacatcctggtgatgaactctctgcagcaaggccaggaaggtgaggcttggtctggccaaggaccaggctcccctgactctt

SEQ ID NO: 10303 - DNA, 310 bp, Canis familiaris
ggaagcagaactttcagctatgaaggtaacaagcgtctttcttctcagtgcgttggccctgttgagcttatctggtaacaccagagccaataacatgctgcagagacaggctaactgtaaccttaaggtgaacggatgtaacaagatctataatcctatctgcgggagtgatggaattacctatgctaatgaatgcttgctatgtcttgaaaataagaaacgacaaacctctatcttggttgaaaaatctgggccttgttgataaccaagattctaaaataccctgtggttactacaatgcctagtgggc

SEQ ID NO: 10304 - DNA, 87 bp, Canis familiaris
  misc_feature (60)..(60): n is a, c, g, or t
gaagcttcagaatatgaactaacagggtcagccttcactgagactcattttccctgaacnctaaaggaaatgctgcctcgtggctac

SEQ ID NO: 10305 - DNA, 356 bp, Canis familiaris
  misc_feature (265)..(265): n is a, c, g, or t
tcttgaacagtctgggctccgtgtatctacagtgtaagattttgatatgtgatagtggtgaccatcagtctcgatgcagccaaggctgtgtctctagaacgaaacgagacctttcttcatacaaatggaagaccgatgctgtcataggacctattcgtctgaaaagggatcgaagtgcaagtggaaatacaggatttcaggatcagatacacaaagaagaaactcagagtcaacctttcagcagtctgcatctattttcattcanggtccttgctctgaatctcgtgattgtggccgtgatcataacaaggcattttgtgaatcagagaacggactacaaataccagaagcttcag

SEQ ID NO: 10306 - DNA, 313 bp, Canis familiaris
tagcatctgctcactattctggtgagcactttgaaggtgagaaggtgttccgcgtcaatgttgaagatgaaaatcatatcaacttactccatacattggccagcaccacccagattgacttctggaaaccagattctgtcacacaaatcaaacctcacagtacagctgacttccgggttaaagcagaagacattttgacggtggaggattttctgaagcagaatgaactacactatgaggtattgataaacaacctgagattggtgctggaaggtcagtttgacagccaggtccgtgcaactggacacagtta

SEQ ID NO: 10307 - DNA, 559 bp, Canis familiaris
  misc_feature (129)..(130): n is a, c, g, or t
  misc_feature (132)..(132): n is a, c, g, or t
  misc_feature (285)..(285): n is a, c, g, or t
  misc_feature (403)..(403): n is a, c, g, or t
  misc_feature (410)..(411): n is a, c, g, or t
  misc_feature (427)..(427): n is a, c, g, or t
atagctacagacaatggccagcctcctgccacgggcaccgggacactgctcctcactttctctcacatagactgcccaggagtagactcacactgccttgacatctgccagaggggaccagagtctcannanggcggaggcatggagcagatcagcagcccactgaccacacatgtgctggacactgcctcagggcttccagctcagggcctctgcctccgtctgtccaggctcgaggaccatggccagcagtggacagagctgaagaaaagctacaccgactcngatggccgctgcccagggctcctgcctccaggcccgatgaaggcaggcacctacaagctgtcctttgacaccgagggctactggaagaagaaagggcaggagagcttctacccatatngtggagnnttgtttttaccatcgncaacgagacacacaggttccacgtgcctctgctgctgagcccatggtcctacaccacgtatcgagggagctagtggctagccatcgcctctggctaactgctggcctgtgagcatcagttccatccccatgg

SEQ ID NO: 10308 - DNA, 265 bp, Canis familiaris
  misc_feature (99)..(99): n is a, c, g, or t
gagccttcgttaaccagcacctgtgtggctcccacctggtagaggctctgtacctggtgtgcggggagcgcggcttcttctacacgcctaaggcccgcngggaggtggaggacctgcaggtgagggacgtggagctggccggggcgcctggcgagggcggcctgcagcccctggccctggagggggccctgcagaagcgaggcatcgtggagcagtgctgcaccagcatctgctccctctaccagctggagaattactgcaacta

SEQ ID NO: 10309 - DNA, 506 bp, Canis familiaris
  misc_feature (108)..(108): n is a, c, g, or t
  misc_feature (136)..(136): n is a, c, g, or t
  misc_feature (154)..(154): n is a, c, g, or t
  misc_feature (209)..(209): n is a, c, g, or t
  misc_feature (284)..(284): n is a, c, g, or t
  misc_feature (457)..(457): n is a, c, g, or t
  misc_feature (478)..(478): n is a, c, g, or t
  misc_feature (481)..(481): n is a, c, g, or t
atttattttgtacatgtgtggtaactgaggtcttcctgttggctgtgatggcctatgaccgcttcgtggccatctgcaacccactgctgtacatggtcaccatgtccnagaatctctgtatggagctggtgtcctnctgctacctctgtggganggcctgttctctgatccacttgtgtttagcccttcagatcccatcctatagatcnaatgtgattaaccacttcttttgtgatctaccccctctcttatctcttgcttgctctgatgtcactatgaatganctgttgctgtacatcgtggccaccttcaacgagctcaccaccatcctgatcatccttacctcctatttgctgattctcatcaccatcctgaggatgcgctctgcagagggaaggcgcaaagccttttccacctgtgcctcccacctcacagccatccttgtcttccatggaanaatccttttcatttattgtcngcnaggttcgggcaacagtatggatgct

SEQ ID NO: 10310 - DNA, 565 bp, Canis familiaris
tattgatggctacgtctacacctggaccaagaaccgaatgtggagaaagacccgctccactcaggctggaactaactgcgttggcacagaccccaacagaaattttgatgctggttggtgcaaaattggagcttctcggaacccctgtgatgaaacttactgtggacctgctgcagagtctgaaaaagagaccaaggccctggctaatttcatccgcagcaacctctcttccattaaagcatatctgacaatccactcatactctcaaatgatgctctacccttattcctatgattataaactcacagagaacaatgctgagttgaatgccctggctaaagctactgtaaaagaacttgccaccctgcatggcaccaagtacacatatggcccgggagctacaacaatctatcctgctgctgggggctctgatgactgggcttatgatcaaggaatcaaatattcctttacctttgaactccgggacaaaggcagatacggctttgccctccccgaatcccagattaggccaacctgtgaggagacactgttggccatcaagcac

SEQ ID NO: 10311 - DNA, 57 bp, Canis familiaris
gcctccggagccaggtgtactctcgtgtccccaggagcctgagggtgtccccgccct

SEQ ID NO: 10312 - DNA, 482 bp, Canis familiaris
gaatgttgaccattgctcttctggccctactctgtgcatcagcctcggccaatgccattcaggctaggtcctcctcatacaatggagagtatggaggtggtggagggcagcgattctcccattctggcaaccagctggaaggccctatcaccgccctccgtgtccgggtcaacagatactacattgtaggcctccaggtgcgctatggcaaggtatggagcgactacgtgggtggcacccagggagatctggaagagatcttcctgcaccccggggagtcagtgatccaggtgtctggcaagtacaagtactacctgaggaagctggtcttcgtgacggacaagggccgctacctgccttttgggaaagacacaggcacgagcttcaacgccgtccccttgtaccccaacactgtgctccgattcatcagcggccgtgctagctccctcatcaatgccattggcctgcactgggacgtctac

SEQ ID NO: 10313 - DNA, 302 bp, Canis familiaris
  misc_feature (68)..(68): n is a, c, g, or t
ggccttgattaaagacttcaccgtgttttccaaccctgcgtgccctccctcgtgccaagtcagctccngggtgagcattctggtggatgaagcgggacatcaggggagccctgggagatcctgcaagaggatgcatgcctccctgggaacatgatacagtctctccttccttgcttcccttgtgtttaagcttattcccaacttactgcctgtgcttggacctgttgtacaacctctttcctcttccacatgaatacctgggtctttctgatgcttggaaaggctctgtggttcttttagga

SEQ ID NO: 10314 - DNA, 573 bp, Canis familiaris
tgaggcccagatgttcacagttgactcacagatgttctacacagtgcccattatggcttttgccttcgtctgccaccctgaggtgctgcccatctacacagagctctgccgatggagggaggatgagggatctcccacaggggcaggcacagatggatgctcagagggtagttcaagtcatatgaccacatggagcaggggaggcagtacctgggccctgactagtgtcctacgctactctgaccacatccgccgggccctgcagcagctgctcttcccaagcagggacttcagctggccacggcatgtggccatagccctgatcctgcttgtcttggtcaacgttcttgtcatttgcgtgccaaccatccgggatatctttggggttattgggtccacctcagcccccagcctcatcttcatccttcctagcatcttctacctccgcattgtcccatctgaggtggagcccctctactcctggcctaagatccaggctctgtgttttggtctcctgggggtcctcttcatggcaatcagtctaggctttatgtttgccaactgggccacagg

SEQ ID NO: 10315 - DNA, 107 bp, Canis familiaris
ggtggcccaaggctcactccaattcctggactctgagggcaggccatttctctccttaggcaccagctgcccctcaccaagtggcttacagcttctccatgtccctg

SEQ ID NO: 10316 - DNA, 473 bp, Canis familiaris
  misc_feature (52)..(52): n is a, c, g, or t
  misc_feature (70)..(70): n is a, c, g, or t
  misc_feature (82)..(82): n is a, c, g, or t
  misc_feature (404)..(404): n is a, c, g, or t
ttgaaagtttcctcctctacgtctgtggctgggctgcgggggcagtagggtnagggtgggtgggaccggncggggtggtgangcaatcaattttctgtaattcagctagcatgactgtttccttgggcttttctgcaagcctctaagattgtgtgtctctccccccacccccacccgcatttcacagaaccactaaatctggcttcgaatttgaaaggatctgaaggtatgcagagtccgggctggcctcaaacccaggcaggaaagagcacagggtctggcaaaggaggatgggattctggactcagcttcctggaaccccttgaggctttttgaaggcagtggggatagctagctttattatagacaaccgtgatcgcatcccctatctaaccagaagaatncaagccccttttttcagtcatctcaaggagtttggagggatcactccctactcagctgccaaggttgaa

SEQ ID NO: 10317 - DNA, 41 bp, Canis familiaris
agcttctacccatatgtggaggttgtttttaccatcgccaa

SEQ ID NO: 10318 - DNA, 163 bp, Canis familiaris
atccactgggatccctacaccgtggagagtggcaactacctggagatcaccaagaagatggaccacaactccctgaagcagcacctgaggactgattacctgcgctattgggccgtgacctacgaggcactgcccaccgtgaccggagatgaggccactcccg

SEQ ID NO: 10319 - DNA, 157 bp, Canis familiaris
ttcacgcagtactgaggccgaggtgggtcccgtgctctcagacgtccccaaaggatggtggagccttggttcactttatgccaaatctatgccaaaaagtgggttatctacgatgcgaccatattcctaataaaaacatggaaatcactgtgtagaa

SEQ ID NO: 10320 - DNA, 135 bp, Canis familiaris
ttctgggactctagatacaagacatactggttttggtgtactggagaagaaatagacaaatatgtgaaatgtcaaaaatctgagctttttaaactttttctttttttctttttacttcaggatgttaatgattgg

SEQ ID NO: 10321 - DNA, 545 bp, Canis familiaris
ggagcatctattcttacgttctgggactctagatacaagacatactggttttggtgtactggagaagaaatagacaaatatgtgaaatgtcaaaaatctgagctttttaaactttttctttttttctttttacttcaggatgttaatgattggtatgggccaccaaataataatgggataattaaagaagttactattaatccagatactacttgtggtaatgattgggtctgtgaacatcgatggcgtcaaataagaaacatggttatgttccgtaatgtagttgatggacaaccttttacaaactggtgggataatggtagcaaccaagtagcttttggaagaggaaacaaagggttcattgtctttaacaatgatgactggccattatctttaactctgcaaactggtcttcctgctggcacatattgtgatgttatttctggagataaaattgacggcaattgtacaggaattaaaatctatatttctggggatgggaatgctcatttttctattagtaactcggctgaagatccatttat

SEQ ID NO: 10322 - DNA, 460 bp, Canis familiaris
  misc_feature (33)..(33): n is a, c, g, or t
  misc_feature (36)..(36): n is a, c, g, or t
aggccagatgccacctgtgaggcataaagccgncanaggcagctcctgagagacctctgctgtctgccatgaagggaagcagcaccctcctgctggtggccctctccttgctctgctcctgcgggctggcctctgacgaggacagcagtgagtttttcatggacttcctgcaaacgctgctggtggggtccccagaggagctgtacgaggggcccctgggcaagtacgacgtcaatgcagatgccaaagcggcgctgactgagctcaagtcctgcatagacggcctacagcccatgcacaaggcggagctggtcaagctactggtgcaagtgctgggcagtgaagatgaagcctaacaaaccccagtcatggctccaggcggccacaggaccagctacacaatcagccacagccacgccaccccatcaccactttcctgtgcgtgaacttatccgaaaac

SEQ ID NO: 10323 - DNA, 299 bp, Canis familiaris
  misc_feature (69)..(69): n is a, c, g, or t
agtgaagttactctcagcatgtagtgctgtctggtgctgaggcctcccagattctggggcaggtctacnccagactggtgccaagaagcctctggtggggttggttggctgattgggccacacagaccaactttcagaaagcatttcccaatactctgactcacattaaccccagtttctctaacccccagtgcatgtgtcctccacatcgcttccaggtttgctctctcacaggtctgtgtctttgagttttgccttcctgaacagactcttagcacttggatgctatgattcactta

SEQ ID NO: 10324 - DNA, 146 bp, Canis familiaris
gtccctctactgcagatgttactgatgtgttagagacacttcatctccaacccccagagagtgcagagcccctcacctgaccttgtcactggggtctgctgaagaccccaagtcccaggaggaaagaacttcttgcctgctcccca

SEQ ID NO: 10325 - DNA, 274 bp, Canis familiaris
  misc_feature (211)..(211): n is a, c, g, or t
acgtgcgccaagctctacgacaagagcgacccctactacgagaactgctgcggcggcgccgagctgtcgctggagcccaacaccgacctgcccttcctgccctccaactgggccaacgtggcctcgtcgctcgtggtggccccgcgctgcgagatcaccgtgtggtccgtacgcggcaaggcgggcaagacgcgcaagttctccaccggcntctacccgcgcctcgaggagttccgcaagggcatcttcggcgactggtccaacaccatcgcgt

SEQ ID NO: 10326 - DNA, 472 bp, Canis familiaris
  misc_feature (33)..(33): n is a, c, g, or t
cttagccaaccaagagggaccttataaaatttncctcatgcacagaccttcctagggctatttcctgtcctactaacacaaagtgagggcttggggtaggctgtattagcaagggagtgtagaggtccaatgtgtcctctgcagggattaatgctgtgtttattgtcttctgctttaactgtatttcagggcaggagaaaacacagtaaaacaaattttgtgcctcctttgcaatttacactagatttgaggccatcacagactaagaaagaagataatccggatacttaacaaccgtgtgaagtagaaaatatttcaatgggttttataagcttaacatactttgataaaatattttgatcactattttaataacccaggggcttattttcctttcttcttagttcttggctgacttttggagacccatgggaaagaaactattttgaatgtaaccccaaagtcactaaga

SEQ ID NO: 10327 - DNA, 150 bp, Canis familiaris
  misc_feature (71)..(71): n is a, c, g, or t
ggaccaagcatgaaggcccagcctggaagggaataatctcacacctgaccacttcattatgacctctcttnctccctgctcatttcacttctcgattttttttgtgtgtgtgtgtgtgtgtgtattaaatggccttagatcttggcgtgt

SEQ ID NO: 10328 - DNA, 341 bp, Canis familiaris
  misc_feature (29)..(29): n is a, c, g, or t
  misc_feature (33)..(34): n is a, c, g, or t
  misc_feature (37)..(37): n is a, c, g, or t
  misc_feature (129)..(129): n is a, c, g, or t
  misc_feature (177)..(177): n is a, c, g, or t
  misc_feature (225)..(225): n is a, c, g, or t
  misc_feature (236)..(236): n is a, c, g, or t
  misc_feature (251)..(251): n is a, c, g, or t
  misc_feature (267)..(267): n is a, c, g, or t
  misc_feature (297)..(297): n is a, c, g, or t
gacccccaaatcctggatggatgctgagntggnntgncagaagaggccctcgggacaccttgtgtctgtgctcagtgggagtgaggcatcctttgtggcctccctggtcaagaacagtgtgaacagctnctcatatgtctggatggggctccatgaccccacagagggctatgagcncaatgcagatggttgggagtggagtagtgctgatattctgaattactntgcctgggagnaaaacccctccaccntcgcaaaccctggctnttgtgggagcctgtcaagaagcacaggatntctgaaatggaaagattataactgtgctacgaagctaccctata

SEQ ID NO: 10329 - DNA, 427 bp, Canis familiaris
  misc_feature (81)..(81): n is a, c, g, or t
  misc_feature (96)..(96): n is a, c, g, or t
  misc_feature (155)..(155): n is a, c, g, or t
  misc_feature (325)..(325): n is a, c, g, or t
  misc_feature (402)..(402): n is a, c, g, or t
tcacaccagctttcttgcaggtcctcacacactgggtgcacaccctttgcctggggatctctctctctccttctgcccttnccaggaggcctcagntccttcaccacttcctcagggagccctgcagacctgtctgataggaaaagctcaccctntggacccactcaccccttcaggtctctttccctcatgctacttagtggagtggtaattttataatatttgcgtgagtccgtagttaatgtttctgtatgccctgtcattgccacactatctgctataatgtagtgtctccgaatgcttttagtattcccaattcttagcncatggcaagtctttgataaatctttgttgaatgaatattattctgactccccaggattgctgtagaacagtcaactngcacatgctcaaataaacccagtag

SEQ ID NO: 10330 - DNA, 559 bp, Canis familiaris
  misc_feature (416)..(416): n is a, c, g, or t
gtcagaaccacccaccaggttgtagccggggagttcgaccagggctcagatgctgagagcatccaggtgctgaagattgccaaggttttcaagaaccccaagttcaacatgttcaccatcaacaacgacatcaccctgctgaagctggccacacccgcccgcttctccaagaccgtgtccgccgtgtgcctgccccaggcgaccgacgacttccctgctgggaccctgtgtgtcaccacgggctggggcctgaccaaacacaccaatgccaacacccccgacaagctacagcaggcggccctgcccctcctgtccaacgccgagtgcaagaagttctggggcagcaagatcaccgatcttatggtctgtgcgggtgccagtggcgtctcctcctgcatgggtgactctggtggccncctggtctgccagaaggatggagcctggactctggtgggcatcgtgtcctggggcagcggtacctgctccacctccactcctggcgtgtacgcccgtgtcaccaagctcataccctgggtacagcagatcctacaagccaact

SEQ ID NO: 10331 - DNA, 223 bp, Canis familiaris
atcgaacctgtcctgaacggcctgtccaggatcgtcaatggggaagacgccgtcccgggctcctggccctggcaggtgtcgctgcaggacagcaccggcttccacttctgcggggggtccctcatcagcgaggactgggtggtcacggccgcccactgcggggtcaggacctctcacctggtcgtggccggggagtttgaccagagctcaagtgaagagaaca

SEQ ID NO: 10332 - DNA, 313 bp, Canis familiaris
tgctcagagacttaccacggcaagttcgccaattccgaagtggaggttaagtccatcgtggactttgtgaagagccacggaaacatcaaggccttcatctccatccacagctactcccagctgctcctgtatccctacggttacaaagcagaagcggcccctgaccagcaagagctggatcagctggccaaggctgctgtgacagcgctcgcctctctgtatgggaccaagttcaagtatggcagcatcatcaaaacaatttaccaagccagtggaagcactgttgactggacctacagccagggcatcaagt

SEQ ID NO: 10333 - DNA, 295 bp, Canis familiaris
  misc_feature (185)..(189): n is a, c, g, or t
  misc_feature (222)..(222): n is a, c, g, or t
tctgctgcccgtggtggactatgagcactgctccaagctggactggtggggcatctctgtaaagaagaccatggtgtgcgctggcggggacatcctctctgggtgcaatggtgactctggaggacctctgaactgccccacaggagatggctcctggcaggttcacggtgtgaccagctttgtgnnnnncttcggctgcaacaccatcaagaagcccacagnattcacacgagtctcagccttcaatgactggatcgaggaggtcatgtcaagccactagaactaaggcctgggt

SEQ ID NO: 10334 - DNA, 524 bp, Canis familiaris
  misc_feature (368)..(368): n is a, c, g, or t
agtgaagagaacatccaggtcctgaagatcgccgaggtgttcaagaaccccaagttcaacatgttcacggtccgcaacgacatcaccctgctgaagctggccacgcccgcccgcttctccgagaccgtgtcccccgtgtgcctgccccaggcgaccgacgagttccccccgggtttgatgtgcgtcaccaccggctgggggcggaccaagtacaacgccaacaagacgcccgacaagctgcagcaggcggccctgcccctcctgtccaacgccgagtgcaagaagttctggggcagcaagatcaccgacgtgatgatttgcgccggtgccagcggcgtctcctcctgcatgggtgactctggtggccncctggtctgccagaaggatggagcctggaccctggtgggcatcgtgtcctggggcagcggcacctgctccacctctgttcctgctgtgtactcccgtgtcactgagctcattccttgggttcaggaaatacttgctgccaactgagctcttggttc

SEQ ID NO: 10335 - DNA, 585 bp, Canis familiaris
  misc_feature (166)..(166): n is a, c, g, or t
cccgagactttgtggcttgcaatcacctaagaagctacaagtattactcgagcagcatcttgagccccgatggcttcctgggctacccgtgtgcctcttaccatgagtttcaggaggatagctgtttcccttgcccagctgaaggatgtccccaaatggggcactntgctgaccgatttcagaggaataccagtgctgtgggacaaacctttttcctgaacacaggagacagcggtaactttacttgttggagatacagggtatcggtcacactggctggaaaaaagaaaacgagtgggtactttaggattgccttgtatggaagtaatgcaaactcaaaacaatatgaaattttcaaaggatccctccaaccacatgcaattcatatgcgtaacattgatgtggacctcaatgttggaaaaatccagaaggttaagttcctctggaacaaccatgtgataaatcttttccggcccaagctgggggcttcacaaatcacagtgcaaagcggtgaaaatgggaccaagtataatttttgtagcagtgacatggtgcgagaagatgttttacagtctctttacccat

SEQ ID NO: 10336 - DNA, 594 bp, Canis familiaris
gatctgggaagggactcgtgactttgtggcctgtaatcacttaagaagttacaagtattactctgatagcatcctcaaccctgacggctttgctggattcccttgtgcctcttacaatgttttcactgcaaacaagtgcttcccctgcccaagcgaaggctgcccacagatgggtcattatgctgacagatttcctggaaaaactgacaaagtgaaccagatattctatctagacactggtgatgccagcaattttgcccgttggaggtataaggtagctgtcacactgtctgggaagaaggttacaggacacgtgctagtttctctgtttggaaataaaggaaattctaaacagtatgaaattttcaagggcactctccaaccagagagcactcattccaatgaatttgactctgatgtggaagttggagatgtgcagaaggttaaatttgtttggtacaacaatgtgatcaacccaactctacccagagtgggagcatccaagatcacagtggaaagaaatgatgggaaaatattcaacttctgtagtaaagaaaccgtgagggaagatattttacttactcttaccccatg

SEQ ID NO: 10337 - DNA, 576 bp, Canis familiaris
aactcgggacttcgtggcttgcaatcacctgagaagttacaagtattactcagagagcatcctcaaccctgatggatttgcttcctacccctgtgcttcctacagggcctttgaatctaacaagtgcttcccctgcccagatcaagggtgcccacagatgggtcactatgctgataaatttgctgtcaagacaagtgatgagacacagaaatacttcctgaacaccggagattccagcaattttgctcgctggagatacggggtttctataacattgtctgggaaaagagccactggtcaggctaaagttgctttgtttggaagtaagggaaatactcatcaattcaatatcttcaaggggattctcaaaccaggctctactcattccaatgagtttgatgcaaagcttgatgttggaacaattgagaaagtcaagtttctttggaataacaacgtggtaaacccaacctttcccaaagtgggtgcagccaagatcaccgtgcaaaagggagaggagaaaacagtgcacagcttctgcagcgaaagcaccgtgagggaggatgttctgctcaccct

SEQ ID NO: 10338 - DNA, 538 bp, Canis familiaris
  misc_feature (54)..(54): n is a, c, g, or t
  misc_feature (194)..(194): n is a, c, g, or t
tccggcatctggctttagagttccatgcaagcttcctgcctccatccacaggcntcttgaaggattcactaatgggctcagaggaggagcagtacatgtagacttaaagacgcagttttctgggatgatgacccactcgcaggttttgtgggattacggagtggagtccaaagccttcaaattagtaagaatcnccgtttccaaagttgaaggaactgggatgttttgtctgaagaagggctctcatataggaacgaaggtgactgctgcctgccttcccaggaaggaactggaacccatggtgacatttcaggaaggccaatttcagctctctgtaaggatcaaaaatgtgagtgatgtgaaaacccgacagaccgtcaccccaaaaagggagcttcacatcactgaagtatccagccaggggaccatccgtggtgttggggcacaagatagaccagtagtctcctgggactggtccagctctaaactggatggagggaaggaaggccgtggctttggatgccctctcaggtagaaa

SEQ ID NO: 10339 - DNA, 431 bp, Canis familiaris
  misc_feature (295)..(295): n is a, c, g, or t
  misc_feature (311)..(311): n is a, c, g, or t
  misc_feature (381)..(381): n is a, c, g, or t
tgggaggctccagtcaatcagatgcccacagagccctaatcctgaacctccattccaatgaggactgtacctggacattacaaagaccagaaaacaaaagcatcagaatcatcttttcctacttccagcttgatcctgatggaccgtgtgaaagtgaaaacattaaagtttttgatggaaactctaccaaggcgtctctgctaggcaaagtctgcagtaaacatgactacattcctgtttttgagtcatcatccagtacattaacggttcaaatagtcaccgactctgtaaaaantcaaagaactgtcttnatcttctactacttcttctcttctggcacctctattccaaactgtggtggttacttggacagccccaaangatcctttaccagccccaattacccaaatgcgcatcctgcactggcttat

SEQ ID NO: 10340 - DNA, 468 bp, Canis familiaris
  misc_feature (331)..(331): n is a, c, g, or t
  misc_feature (347)..(347): n is a, c, g, or t
  misc_feature (391)..(393): n is a, c, g, or t
  misc_feature (396)..(399): n is a, c, g, or t
  misc_feature (402)..(404): n is a, c, g, or t
  misc_feature (407)..(407): n is a, c, g, or t
  misc_feature (413)..(414): n is a, c, g, or t
  misc_feature (418)..(418): n is a, c, g, or t
gacttctcttgtggtttcttctgctctgggtgcttatcgggaagtcacacaccgaagaagacatcgtaattacaaccaagaatggaaaagtccgagggatgaacttgccggttcttggtggcacagtcacagcctttcttggaattccctacgcacagccacctcttggtagacttcgattcaaaaagccgcaattcttgaccaaatggtccgatatttggaatgccacaaaatatgcaaattcttgctatcagaacacagatcaaagtttcccaggtttccctggatcagagatgtggaacccaaacactgatctcagcgaagactgttntatatctgaatgtgtnggattccaacacctaaaccaaaaaacgccactgtaatgatatgnnnatnnnnggnnnggnggtttnnaaancaggaacatcatctttacctgtttatgatggcaaatttctggctcgggtt

SEQ ID NO: 10341 - DNA, 457 bp, Canis familiaris
gaattttctgtgctgaagtcatttttctctgccatctcagagaaaaagcaagaatttacatttaatcttgccaatgccctctaccttcaagaaggattcactgtgaaagaacagtatctccatagcaacaaggaattttttcagagtgccataaaactggtggattttcaggatgcaaagacttctgcagagacaataagtacctgggtagaaagcaaaacagatgggaaaattaaagacatgttttcaggggaagactttggccctctgactcgacttgtcctggtgaatgctatttatttcaagggcgactggaagcagaaattcagaaaagaggacacacagttgacgaattttactaagaaagatggtgcagcagtcaaaattccaatgatgaaggctcttctgagaacaaaatacggttatttttctgagccctccatgaactaccaggttt

SEQ ID NO: 10342 - DNA, 58 bp, Canis familiaris
ggctcagatgcccatagtcattggcttctaatgcccttggctccaagaagacccaggg

SEQ ID NO: 10343 - DNA, 479 bp, Canis familiaris
gagccccgctactacgagagctggacccgggagaccgagtccacctggctcacctacaccgactcggacgcgccgcccagcgccgctgccgcggacagcggccccgaggcgggcggcctgcaggcggactccagtgccattctctgtttccctccccaaggtgtgctggaagatggactgtcctccaatggtataccccgatctgcagccccaggtggaatatccaacccggagaagaagatgagctgtgggacccagtgcccgaatccccagagcctcacctcaggccctctgacccagaaacagaatggccttcggaccatggaggttaaaagagacgctaagcgaatgtctgcaaaagaagttaccattaacgtgacagaaagtatccgacaggtggacagaaatcgaaggatggcgaagaactgtgttaactagcagagtgtgctactagaagggcagatggactcctttggtgc

SEQ ID NO: 10344 - DNA, 42 bp, Canis familiaris
gagggcagtgcctggataagtatcattcagggaaactaaagc

SEQ ID NO: 10345 - DNA, 269 bp, Canis familiaris
atgtgtctcctgaagctgccagtagttctcatcatactctcggttgcattaaaccatctgaaggctactcccattaaaagtcaccagatggaaaagcggaaatgcaacactgccacgtgtgcgactcaacgcctggcaaatttcttggttcgtactagcaataatcttggtgccattctctcgcctaccaatgtgggatccaatacatatggcaagagaaacacaattgagattttaaacaggggaccattgaattacttaccacttta

SEQ ID NO: 10346 - DNA, 522 bp, Canis familiaris
  misc_feature (118)..(118): n is a, c, g, or t
  misc_feature (316)..(316): n is a, c, g, or t
  misc_feature (391)..(391): n is a, c, g, or t
  misc_feature (408)..(408): n is a, c, g, or t
ggccacgtccaagttgggcgcatatacctcctctacggcaatgacctgggcctgccccccatcgacctggatctggacaaggaggcccacgtgatcctggagggcttccagtcctcangtcggtttggctcggctgtggctgtgttggacttcaaccaggacggcgtgcctgacctggccgtgggagcgccctcagtgggctctgagcagctcacctacacgggtgcggtgtacgtctacttcggctccaaacaaggaggaatggctgcttgccccaacgtcaccatctcctgccaggacacctactgtaacttgngctggacactcttggccgcagatgtgaatgaagatggagagcccgatctggtgatgggctcccctttcgcaccangtggagggaaacagaanggaatggtggctgcgttttattctgcccccagctggagcaaccaagaaaagctgaacgtggaggcggccccctggatggtgcgcggtgaggaggacttctcctggctaggctac

SEQ ID NO: 10347 - DNA, 466 bp, Canis familiaris
gagagttcactgtcaggatggccttgttccaagaccagagctacatatctccttatgaaggggctgcagctgtgctggctgtcgaatccatgctctatgtgggtgccatcttggagaaaggggacacctcccggtttaacctattgttgaggaactgctatgccacacctactaaagacaagactgaccctgtgaaatatttcatcatcagaaacagctgcccaaatcaatatgattccaccatccatgtggaggagaatggggtgtcctcagaaagccggttctcagttcagatgttcatgtttgctggaaattatgacctagtgttcctgcattgtgagattcatctctgcgattcccttaatgaacagtgccagccgtcttgctcgagaagtcaacagcgtagtgaaatagtggctatcaacccagctcgggttctagatttgggacccatcactcggagaag

SEQ ID NO: 10348 - DNA, 159 bp, Canis familiaris
caacatctgtactagtagagaatgctgacaaccttatttcaaagtgttcactctctttcctatcctgaaatcttatttttgtctgcctggatattttccagatcccaatctttttataagcttctactctgttaaactacttggatcttttaatactga

SEQ ID NO: 10349 - DNA, 518 bp, Canis familiaris
gaagacccggtccaaggtatcaggaagcttctgtgtcggtgttgaccctaaccggaattgggacgcaggttttggagggccaggagccagcaacaatccttgctctgattcctaccatggaccccatgccaactctgaagttgaagtgaaatccatagtggacttcatcaagagtcacgggaaaatcaaggccttcattaccctccacagctattcccagctgctcatgttcccctatgggtatacatgtaccaagtcagataatttcgatgaactgaatgaagtggcccaaaaagctgcccaatctctggccagcctgcatggtaccaagtacaaagtgggacctatctgctcagtcatctaccaagccagcggaggaagcattgactggtcatatgactatggcatcaaatactcatttgcctttgaactgagggacacgggtcgatatggcttccttctgccggccaatcagatcttgcccacagctgaagagacctggcttggcttgaagacaa

SEQ ID NO: 10350 - DNA, 550 bp, Canis familiaris
  misc_feature (347)..(347): n is a, c, g, or t
gttggcacttacttatgtctcgctacagacaaggtggtgcagttccaggcctctccctgccccaaggagtcgaacagggctctgctcaacgacagctcttgctggaccatcattggcacagagtcagtggagttctccttcagcaccagcctggcgtggacccgggaaccagtcactccagtacccctcatcagcaccctggagctgagcggtgggggcgacgtggccacgctggagcttcacggtgagaacttccacgcggggctcaaggtgtggtttggggacgtggaggccgaaaccatgtacaggagcccgcggtccctggtgtgcgtggtacccgacatagncgccttcggcagcgactggcgctggctgcgcacccccatcacggtgcccgtgagcctggtgcgcgccgacggcctcttctaccccagcgccttctccttcacctacaccccggagtacagcgcgcggccgggccccccgggcgccctcgagcccgccacggacgccgacgcgctcctcgagagcatccaccacgagttcacgc

SEQ ID NO: 10351 - DNA, 235 bp, Canis familiaris
ccaagagacacgccgccttcctcaaggatgtctgggccaaagagccggtgctggttgcgtccttcaccattgggggcctcgctgtgattctgctcaccctcagtcccttcaccaagtacgccaccatgatcaaccaggccatgccctacaactatccagtgcctctccaagatgatgggaacatgcccgatgtgctccaggactcccagggccccagcctggagtggctaaagga

SEQ ID NO: 10352 - DNA, 318 bp, Canis familiaris
aagctaccctacgtctgcaagtaatcgaattcccgcggccgccatgtgtcaagaagcacaggatacctgaaatggaaagattataactgtgctacgaagctaccctatatctgcaagttcaaggactaggtctggggagacctcaggaacctgagttttacatgcagctcatcatggacatgggaccaagcatgaatactcaccctagagtcttcaaataaatatcctcccatacctccaaactgaccacatcattatgaccttccctacttctcagccttatctaaaataccgctgtgtcttccataacttgagttc

SEQ ID NO: 10353 - DNA, 201 bp, Canis familiaris
  misc_feature (42)..(42): n is a, c, g, or t
  misc_feature (130)..(131): n is a, c, g, or t
ttcctgagaaatcacctgctatcaactgggcttactacaagnccaatgtggcaaaagctggcttggtagatgactttgagaagaagtttgatgccctgaaggttcctgtgcaagaggataaatacactgnncaggtggatgctgagaaaaaagaagacgtgaaaagctgtgctgagtttctgtctatctcaaaggccagga

SEQ ID NO: 10354 - DNA, 449 bp, Canis familiaris
agcacggattctgaggttctgggccactacaacatcactgggaacaccatttctctctttcgcctggtggacaacaaaaaactggatttagagagcaaatacattgaaagcattgatgccaccaaattaagccgtttcattgagatcaacagtctccacttggtgacagagtacaaccctgcgactgtgattggcctatttaatagcatgatccagattcatcttctactgatgatgaacaacgcctctccagagtatgaagaaagcatgtccagataccagaaggcagccaagctcttccaggggaaaattctttttgttctggtggacagtggcgtggaggcaaatgggaaggtgatctcatttttcaaactaaagaagtctcaactgcctgctttggcaatttaccgtactgtagatgaagagtgggatacactgcccatggcaga

SEQ ID NO: 10355 - DNA, 215 bp, Canis familiaris
  misc_feature (101)..(101): n is a, c, g, or t
aactcatttctatttcatctgcatagtgtatatttcatattaaaatacgctgatgatagagtgcaagtgaatagggggctccaggcaagaggtgaatttanattttaagtgcactagtgagtactactcctttatgcctttttaccattttttggactagagcatatttaacatccctatatgttgttagccattcccatgtgccctttggattg

SEQ ID NO: 10356 - DNA, 255 bp, Canis familiaris
tagagcctttccctgtctgcacagtcaagcattgtggatgaggttttcctgagcaccctctccccgtggtcccctgaaatgtcaccacaactcaactcagcaactcaactcaactcgagtttgtggaaggagggatggagactggtcacctccacttccagtgtgaacacggggtgggggtgtggcaagggcacgccctccgtaccttctcgggccagacaaaagtttaacatggagattgacaaatgcctttaa

SEQ ID NO: 10357 - DNA, 129 bp, Canis familiaris
gggcaagcagggtgtcatcccccctgcggcgaggccgggacgccggccaggtaagaagccgcatcccgccaggaagtctcggccaaaggcaccacctgtggatgacatggaggttgaagagctggtact

SEQ ID NO: 10358 - DNA, 526 bp, Canis familiaris
aaagttaccctcaacagctatgtccagctgggtgtcctgccgcaggagggagccatcctggccaacaacagtccctgctacatcacaggctggggcctgaccaagaccaatgggcagctggcccaggttctgcagcaggcgtacctgcccaccgtggactacgccatctgctccagctcctcctactggggctccatcgtgaagaaatccatggtgtgcgctggaggagacggaattcgctctggatgccagggtgattctgggggccccctccattgctcggtgaatggcaagtacactgtccatggagtgaccagctttgtgtccagcctgggctgtaacgtctccaggaagcccacagtcttcacccgggtctctgcttacatcacctggataaacaacgtcattgcctccaactgaacatcttcctgaacccaaaggccttcctaagtgatgcttggatccacagtaggacttgaggccatcaggggaaaaatgttctgaaagacctttgagccagatacag

SEQ ID NO: 10359 - DNA, 326 bp, Canis familiaris
  misc_feature (199)..(199): n is a, c, g, or t
ggctgtgagctgaccaacgtcaccatcgcggtggagaaggaggagtgtcgcttctgcataagcgtcaacgccacctggtgtgccggctactgctacacgcgggatctcgtgtacaaggacgcggccaggcccagcatccagaagacatgcaccttcagggagctggcgtacgagacggtgagagtgcccggctgcgccngccacgcggactccctgcacacgtatccagtcgccaccgagtgtcactgcggcaggtgtgacagcgacagcaccgactgcacggtgcgcggcctggggcccggctactgctccttcggagagccgca

SEQ ID NO: 10360 - DNA, 490 bp, Canis familiaris
ttagaccaatggctcatccaacagccactcccaaaattctgtgcagttttgctcaggtcatgctaacagggaaacctcaaatataagcctaactagccttctgggatcaaaagttagaggaaaaatctgattttattacctagatctgttttacagacagctggatttcacaccctgttgtcagcaaaacagctagttaggtagaaacacatagttccaagtagttaaagtcacctgattaaaatgttcttacctatcgtctctgtagttcctctatgcaggacggtacaaatttgcgggacatgctcctggtaacacacagatatgggttatgtatgacatccaaaattatagctgatattgatgggtaacaactgctaaggtccacagaatgaagaatgtattgtattgagggatagaaattgatcacacaatgggtaacaaccacagagctcgaagatttgtgattgttaaaacttctctggcactt

SEQ ID NO: 10361 - DNA, 522 bp, Canis familiaris
agagcatctcctccgaactggaaggcaagatcatgccagttaaatacgaagaaaattctctcatctgggtggctgtagaccagcctgtgaaggacaacagcttcttgagttctaggatcttagaactctgtggcgaccttcctattttctggctgaagccaacgtatccaagagaaatccagagagaaagaagagaattggcaagaaaaatcgttacaactactacaagacgaccacgcagtggaccacggggcaacccaggccctggaggaccaaataatgaaaccagacccagtgttcaagaggattcagaacccttcaatccagacaacccttaccaccagcaggaaggggaaagcatgacatttgaccctagactggatcacgaaggaatctgctgtatagaatgcagacggagctacactcattgccagaagatctgtgaacccctggggggctactatccatggccttataattatcaaggttgccgatcagcctgcagagttgtcatgccttgta

SEQ ID NO: 10362 - DNA, 473 bp, Canis familiaris
agagaaagcccaagatcacggcctcccggaaactcctgctgaagagcctgatgctggccaaggccaaggagtgctgggagcaggagcacgaggagcgggaggctgagaaggcccgctacctgtgccgggacctgcacgccaaggtggaggtggtggatgaggagagatatgacattgaggccaaatgcctgcacaacaccagggagattaaggacctgaagctgaaggtgctggacctccgtgggaagttcaagcgcccgccgctgcgccgggtccgggtctcggctgatgccatgctcagggccctcctgggctcgaagcacaaggtgtctatggacctgcgggccaacctgaagtccgtgaagaaggaggacacagagaaggaacgccccgtggaggtgggggactggaggaagaacgtggaggccatgtccgggatggagggccggaagaagatgttcgacgccgccaag

SEQ ID NO: 10363 - DNA, 296 bp, Canis familiaris
atgtctaactaagtggagctctcaagatcaagcattatttacgaagactggctggaaagttattgcagtaacacccatgactcaccgtccagacctgcttaccatcattcagacagcaaaacaacatggaccgttctagactgaaggactccctgaatttttatatacttcatgttcctctctgaattgtattcataccacacaaatcaagtgtctcctgctctagacaaaaaggataaaatactgacaacctcaaattcaagcaccacttttaattttccaccaggagtcaatgg

SEQ ID NO: 10364 - DNA, 356 bp, Canis familiaris
  misc_feature (32)..(32): n is a, c, g, or t
tacaggacatcccaatacccatgctaactganttatgtgaggccatgaagaaaaatacctacgtccggagcttcagtcttgtggccacaaggagtggggaccccattgccaatgcggtggctgacatgttgcgtgagaatcgtagcctccacagcctgaacattgaatccaacttcattagcagcacagggctcatggctgtgctgaaggcagttcgggaaaatgccacactcactgagctgcgtgtagacaaccagcgccagtggcctggtgatgcagtggagatgggagatggccaccgttctcgaacagtgtccctccattgtccgctttggctaccactttacacagcaggg

SEQ ID NO: 10365 - DNA, 416 bp, Canis familiaris
atgatcgctgagttcaaggctgccttcgacatgttcgacgctgatggtggcggggacattagcgtcaaggagttgggcacggtgatgaggatgctgggccagacccccaccaaagaggagctggacgccatcatcgaggaggtggacgaggatggaagcggcaccatcgacttcgaggagttcttggtcatgatggtgcgccagatgaaagaggatgcgaagggcaagagcgaggaggagctggccgagtgtttccgcatcttcgacaggaacgcagacggctacatcgatgcggaggagctggctgaaatcttcagggcctccggggagcacgtgacagacgaggagattgagtccctgatgaaagacggcgacaagaacaacgacggccgcatcgacttcgacgagttcctgaa

SEQ ID NO: 10366 - DNA, 292 bp, Canis familiaris
tccatctctttgaaccgtgtcacagatccagaagatgaaagaaggaagtaaccagtccttttgccccttcttccccaccctgatagtgatgcatcttcagccagagctgtggcacaaactcccacgttcccctccctgacatttttctgtttataaacatgatggtcccttccactttgcaccctcaacaccccatcttcccttctgctcttgtaaaacctcccctccccaaccccgtggggcttgcagggacaaggcgacggattgagctgagctgcttatttattgaaaa

SEQ ID NO: 10367 - DNA, 587 bp, Canis familiaris
  misc_feature (45)..(45): n is a, c, g, or t
gggattctcctacagcaaaggcagcagtggaggccaggccggggngagtggctctgccacacatcatggctctgaccagcatcaccatcagggctctgggtctggatctgggggtacaggtggtcctgggggccagactggcaaaggaggagctgctggaacagcagggacgggtggagaaggaaaacatatcactgtgttcaagacctatatttccccatgggagagagccatgggggtggactctcagcagaaagtggagcttggcatcgacttactggcctatggggccaaacctgaacttccccaatataagtcctttaacaggacagcaatgccttatggtggatatgagaaggcctccaaacgcatgaccttccagatgcccaagtttgacctggggcccctactgagtgaacccttggtcctctacaaccagagcctctccaacaggccttctttcaatcgaacccctattccttggctgagctctggggaaccagtagattacaatgtggatattggcatccccttggatggagaaacagaggagctgtgaggtgtttcctcctctactttgtatcaat

SEQ ID NO: 10368 - DNA, 544 bp, Canis familiaris
  misc_feature (193)..(193): n is a, c, g, or t
agaaacgcaacagggccatcacggcccggagacagcacctgaagagtgtcatgctccagattgccgcccaggagctggagaaagaagagagtcgccgtgagtctgagaagcagaactacctgtctgagcactgcccgcctctgcacctgcccggctccatgtccgaagtgcaggagctctgcaaacagctgcntgccaagatcgacgcagccgaggaggagaagtatgacatggaagtgagggttcagaagagcaccaaggagctggaggacatgaaccagaagctgttcgacctgagaggcaagttcaagaggcccccgttgaggagggtgcgcatgtctgccgacgcgatgctcaaggcgctgctgggctccaagcacaaggtgtgcatggacctgagggccaacctgaagcaggtcaagaaggaggacaccgagaaggagcgggacctgcgtgacgtgggtgactggcggaagaacatcgaggagaagtctggcatggagggcaggaagaagatgtttgagactgagtcctaggccacttg

SEQ ID NO: 10369 - DNA, 589 bp, Canis familiaris
gctctcattgacagccactttgaagcacgcaagaaggaggaagaggagctgattgctcttaaggagaggattgagaagcgccgcgcagagagagccgagcagcagagaatccgcgccgaaaaggagagagagcgccagaacagactggcggaagaaaaagcccggagggaggaggaggatgccaagaggagagccgaggatgacctgaagaagaagaaagccctgtcctccatgggcgccaactacagcagctacctggccaaggctgaccagaagagaggcaagaagcagactgcccgggagatgaagaagaaggttctggcagagagacgcaagccactcaacattgaccacctcagtgaggacaagctgagggacaaggccaaggagctctgggacaccctctaccaactggaaacagacaagtttgagtttggggagaagctgaagcgccagaaatatgatatcatgaacatgcgggccagagtggagatgctggccaagtttagcaagaaggccggggccccggccaagggcaaagttggtgggcgttggaagtgaagcagccgcagaagctcccagaggcaga

SEQ ID NO: 10370 - DNA, 391 bp, Canis familiaris
tcccgaatgacgtcctgttcctagaccacatccgccagggtgacttggagcaggtcgggcgcttcatccgggctcggaaagtcgccctggacaccatccacccgtcaggcctggccgccctgcacgaagcagtgctctctggaaacctggagtgcgtgaagctgctggtcaaatacggcgcagacatccaccagcgggacgagaccgggtggacacccctgcacatcgcctgcagtgacggctatcccgacatagccaggtacctcatctccctgggggcagacagagacgccaccaacgatgacggggacctgccctctgacctcatcgacccggacttcaaggacctggtggagctcttccaagggaccaagatggactgagccccgcc

SEQ ID NO: 10371 - DNA, 507 bp, Canis familiaris
  misc_feature (36)..(36): n is a, c, g, or t
  misc_feature (80)..(80): n is a, c, g, or t
  misc_feature (258)..(258): n is a, c, g, or t
tgctgcctggtggttcatgtatgcagatgacgggcntggtgtcacctacagccagctggtagggaggacagagaaagganaagggtggggagcaggagggaggcatggaggcttctgtgggatgccactttctcactcctccccctgcagactcacttcatgcagtgcaatgaggaaaaccaattttgagggcgtggactgcgagatctttgaggcccctgagcccatgaccatggccttgtccgtgctggtcaccanagaaatgtgcaacgctctcaacagcctgtctgagaaccagtccctcctgcggatgcccccctgggtaaacatctggctgctgggctccatctgcctctccatgtccctccacttcctcatcctctacgttgaccctctgccgatgatcttcaagctccgggccctggacttcacccagtggcttatggtcctcaagatctcatttccagtcattgggctcgatgaggtcctcaagttcattgctcggaa

SEQ ID NO: 10372 - DNA, 282 bp, Canis familiaris
taatgccaagaagcccagacagccttgtggacatgtgcaatgtgttacagttctgtggtctccccacactcacaatgaagcggctgtctggaaatgtaaaggctgcgccttcctaaaaataatgctaccaaaagagcatttagatatttcttaacaaatccatcagtgactacagcaacgatgacgaaaacctgccaagatgatgaacctggtggtagcttcacaagtcgttcaggcataaaagtctcacgcaagaaaaaccaagtcccctgatttttcatg

SEQ ID NO: 10373 - DNA, 494 bp, Canis familiaris
  misc_feature (47)..(47): n is a, c, g, or t
  misc_feature (54)..(54): n is a, c, g, or t
  misc_feature (67)..(67): n is a, c, g, or t
  misc_feature (73)..(73): n is a, c, g, or t
  misc_feature (93)..(93): n is a, c, g, or t
  misc_feature (98)..(98): n is a, c, g, or t
  misc_feature (104)..(104): n is a, c, g, or t
  misc_feature (113)..(113): n is a, c, g, or t
  misc_feature (117)..(117): n is a, c, g, or t
  misc_feature (133)..(134): n is a, c, g, or t
  misc_feature (160)..(160): n is a, c, g, or t
  misc_feature (380)..(380): n is a, c, g, or t
  misc_feature (382)..(382): n is a, c, g, or t
  misc_feature (384)..(387): n is a, c, g, or t
aggaattcaattactggtgctatattttatacataatacattatccngttaaangcgttgactattncacagncaaggaattatgaatctttngtcanacagtntttctcatncagnggaatccattgtatcnncagtttccaagcagtattgaatagtnctaggatggtttgggttgtcagctgggacatgaaaaaaatagctttatcacacagaactggatattataatatatactcactaaaatggaattctaacagttcaataaacttccagtggattaattaaaatcatcccccatactgtatcataccaagatttgatttgcataccatctgttgcaatgcacttggctttactttattgtcaatgagaattantnannnncaaatgccttcgtggttttgtccatgctagacttatgatttcacaccccctccgaaatcattatcctaaagtaactttccttaggcatctatttgctgggaatcttc

SEQ ID NO: 10374 - DNA, 236 bp, Canis familiaris
  misc_feature (167)..(167): n is a, c, g, or t
attttctcttctcatgttcaatttgaaagggaatgctaagcaggatgtccctactgtaaatccagtatcctggtgggaatggagggaaaaaggagggaaatatctatctttccagtcttcactccaagtccccactccaagcatccttcctcaccagctcagagctntccttctacttgctctgtatggaacctgttcttttatggaatttgctctgccaccggtaacagtcaata

SEQ ID NO: 10375 - DNA, 427 bp, Canis familiaris
  misc_feature (27)..(27): n is a, c, g, or t
  misc_feature (123)..(123): n is a, c, g, or t
  misc_feature (229)..(230): n is a, c, g, or t
  misc_feature (240)..(240): n is a, c, g, or t
  misc_feature (353)..(353): n is a, c, g, or t
agatcagctcttgaatgacattcgtcncagcaacgttgcctatcttaaacccgtgcaactgccaaaagaactggcataaatggcaacagaataatctagaagaacaaggaattgagataatgnctcgggtcagagcttggacagtttcagcaacatacttccggagccaggtggtggaaccaggaacaaggctggcatctgatagaagcattttgtcaaggcagaggcnnaaaaaaaaanggggggggggtggagctgacaaggaatggggaaggagagaaaaagaaaaagaattactattctgggacattttctacttccaatcagtttgagtaattacaatatttagtcangcttccagcagcagaagttaaaaaaaatttttttcacaaacatttgttttactattgctttcttctggtcgata

SEQ ID NO: 10376 - DNA, 376 bp, Canis familiaris
ggagatgttgctggactttgtcaatgcgatgaagaaaaacaaacacatcaaaaccttcagtttagcgaacgtgggcgccgacgagaacgttgcctttgccttggctaacatgttgcgggaaaataggagcattaccactctcaacatcgagtccaatttcatcacaggcaaaggaattgtggccatcatgaggtgtctccagttcaacgagacactcaccgagcttcggtttcacaatcaaagacacatgctgggccatcacgctgaaatggaaatatccaggctgttgaaggcaaacaccactctcctgaagatgggctaccattttgagctcccaggtcccaggatggtggtaaccaatctgctcaccaggaat

SEQ ID NO: 10377 - DNA, 541 bp, Canis familiaris
aacatcgtggtgctcaacagcctgagaaaggaacgaggcatgaatacattcctgttccgacctcactgtggggaagctggggctatcacccatctcatgacagcattcatgacagcagataatatctctcatggcctgaatttaaaaaagagtcctgtgttacagtacttgtttttcttagcccagattcccatcgctatgtcgccattaagtaacaacagcttatttctagaatatgccaaaaatccttttctagatttcctccagaagggattaatgatctcgctgtcgacagatgacccaatgcaattccacttcaccaaggagcccctaatggaggaatatgccattgctgcacaagtgttcaagcttagtacctgtgatatgtgtgaagtggcaagaaacagtgttctgcaatgtggaatttctcatgaggagaaagtaaagtttctgggtgacaattaccttgaggaaggccctatgggaaatgatatccggaagacaaatgttgcccaaatccgcatggcctatcgctatgaaa

SEQ ID NO: 10378 - DNA, 550 bp, Canis familiaris
agaagtctgctatcagttctcaccgagccaactctgagaatggggatatccacccgggagctgtttctcaacttcactattgtcctgatcaccgttattcttatgtggctccttgtgaggtcctatcagtactgagaagccatgtcatgctcctgggattgactgcaactctccagagctgctgctctgagctcccactgctgtcatgggatgcttttctcagcaccccagggcatttctgacccacactcacaatatctgaggtgcctccagtgttaggattgattgtgtgtactctaaagatgctgcttgcaagcgctgccaagtatttgccagtgagcattagatttattcctcaactcttactgcaaatgtgttagacaagccacaaggttaaaattaaatgattcatgatggtgtagaattgtaacaagcccctgatctgtcttaccacacagcccttccacccacactgtctgcaaccaaacactaaatcaactcaccagaagaaagaaatgttagaggaagtcattgtcaacccctgtagcta

SEQ ID NO: 10379 - DNA, 263 bp, Canis familiaris
gaaatatgatatcaccaatctcagaagccgcatcgatcaggcccagaagcatagcaagaaggccggggccccggccaagggcaaagttggtgggcgttggaagtgaagcagccgcagaagctcccagaggcagagaccctcggcctgagctgcccccatggcagcgtctggccccccggcctgagggcggagagcctgcccccaggcaccccacatgtctctgtcctggctgcccccatctccgggggtctgtgaataaagct

SEQ ID NO: 10380 - DNA, 178 bp, Canis familiaris
gaaaccacctgctattgttgccaaaaagcctgaaccaccaccagtgaaagaagtaaaactaactaatatctttaaagtgccagaggtgccaaagaaacctgtctttgaagaggaaccagccattcctgttcccgagaaagcagagtctcctcctccagaaggtacatataagaccatt

SEQ ID NO: 10381 - DNA, 35 bp, Canis familiaris
tcctcctccaaaagtgcctgaggtacccaaggaag

SEQ ID NO: 10382 - DNA, 151 bp, Canis familiaris
ccctccagtgcatgaggagcctgaagaagttgcctgggaagagcccccggccgaagctgtggaagagccagagcctgctcctcctccaaaagtgcctgaggtacccaaggaagttgtccctgaaaagaaggtgcctccagtggttcccaaa

SEQ ID NO: 10383 - DNA, 437 bp, Canis familiaris
cagggtccgtgaacttgaaggagaagttgaaagtgaacagaagcacaacattgaaactgtcaagagtctacgcaaacatgagaggagagtgaaagaactaacttaccagactgaggaagaccgcaagaacgtgctcaggctccaagatctggtggataaactgcaagcgaaggtgaaagcttacaagagacaagctgaggaagcggaggaacaatccaacgtcaacctctccaaattccgcaagctccagcacgagctggaggaggccgaggagcgggctgacattgccgaatcccaggtcaacaagctgcgggtgaagagccgggaggttcacacgaaaatcataagtgaagagtgattcaaccaaatgctaaaaagtgaccaaagaaatgcacaaaatgtgaacatctttgtcactctgttttctacttcagtat

SEQ ID NO: 10384 - DNA, 426 bp, Canis familiaris
agagtgagcaaaagcgtaacgcggaagctgtgaaaggtctgcggaaacacgagaggcgagtaaaggaactcacttaccagacggaagaagatcggaaaaatattctcagacttcaggatttggtagataaacttcaagccaaagtgaaatcttacaagagacaagctgaggaggctgaggaacaatccaacacaaatctatctaaattccgcaagctccagcatgagctggaggaggctgaggagcgggctgacattgccgagtcccaggtcaacaagttgcgggtgaagagccgagaggttcacacgaaagtcataagtgaagagtgatcatgtccggatgctatggaatgattgaagagaggcacaaaatgtgaagtctttggtcatttccctctataattattgtctattctaccctattgca

SEQ ID NO: 10385 - DNA, 391 bp, Canis familiaris
tgccccagccaaacccaaagaagaaaaaattgacctctctgccattaagatcgagttctctaaggaacagcaggatgaattcaaggaggcatttctcctgtttgacagaacaggtgacagtaagatcaccttaagccaggttggcgatgtccttcgggctctgggcacaaatcccaccaatgcggaggtcaagaaggtgctgggaaaccccagcaatgaagagatgaatgccaagaaaattgagtttgaacaatttctgcccatgatgcaagctatttccaacaacaaggaccagggcacttatgaagactttgttgagggtctgcgtgtctttgacaaggaaggcaacggcacagtcatgggtgctgaactccgtcatgttttagccaca

SEQ ID NO: 10386 - DNA, 414 bp, Canis familiaris
gggtagggcaaagatccctgctcacctccctcagtaaacttcttgggaagaaaaaggagctacaagacttggagctcacgcttgaaggggctctagacaaaggacatgaagtgaccctggaggcactcccaaaagatgtcttggtatcaaaggaggctatgggtggcatcctctatttccttggagccctaacagagctaagtgaagcccaacagaagctactgataaaatcgatggagaaaaagatcctatccgtgcagctaaagctggtggagagcacaatggaacacagtttcctacaggataaagagggtgttttccccctgcagcctgacctgctctcctcccttggggaagaggaactgaccctcacagaggccctagtggggctgagtggcctcgaagtgcagagat

SEQ ID NO: 10387 - DNA, 67 bp, Canis familiaris
tggagtgtgagctaaatgaagattcaatgagtgtgttttctagcatcctctctactttttactgcct

SEQ ID NO: 10388 - DNA, 286 bp, Canis familiaris
agagagctgctctatttccttcattgctctaatatggcagacgccccgtaacacctcttttttctttacttcccaaaattgtagactccaaatcccttttctcattctctcctactgcttagattcccctggtactacagtgccctccctgccagataaccattctctaaagtttcctctgtcatgtctttgagatggtacaatccagtagctaacccttcccattcagattcttgactgggaaacccctgaaatgtcccatagtaactctggttcctggacaagt

SEQ ID NO: 10389 - DNA, 348 bp, Canis familiaris
catgtcctacccagtgaccagtcagccccagtgcgccagcagttgttaccagacccagctcagtgattggcacacgggcctcaccgactgctgcaatgacatgcccgtctgtctgtgcggcaccttcgcgcccctgtgcctggcctgccgcatctccgacgacttcggggagtgctgctgcgcgccctacctgcccggaggcctgcactccctgcgcaccggcatgcgggagcgctatcacatccagggctccgtggggcacgactgggcggccctcaccttttgtttgccctgcgccctctgtcagatggcgcgggaattgaagatccgagagtgaggaggctcccc

SEQ ID NO: 10390 - DNA, 473 bp, Canis familiaris
gtgcttctctatctacatcaacaatcccatagtcaaattctggtcctgcctctttcttctcagcaagatcattgaacttggagacacggccttcatcatcctgcgtaagcggccactcatctttgtacactggtaccaccacagcacagtgctagtgtacacaagctttggatacaagaacaaagtgccttcaggcggctggttcatgaccatgaactacggtgtgcattctatcatgtacatctactacactctgagggctgccaaagtgaagtcccccacgtggttacccatgctcatcaccagcttgcagctcctgcagatgtttatgggagccactatcagcatcctaacttacatctggagacaggaacagggatgccacaccacagcggaacacttcttctggtccctcatcttatatgcgacctatttcatcctctttgcccatttcttccaccaaacctatatag

SEQ ID NO: 10391 - DNA, 581 bp, Canis familiaris
  misc_feature (506)..(506): n is a, c, g, or t
gagcagaaactgcacctggaacagtgtctggaacagcatcaggaacaacaagagtcacaggaccagaaactgtacccggagaagtgtctggaacagcagcaggagcaacaagagtcacaggaccagaaactgtacccggagcagtgtctggaacagcagcaggagcaacaagagtcacaggagaaggaacttcatctggaacaggaacagcagaaggaggagctacagcagcaggaacagcagcagggaaaggaacagtgtgagaaacatcaggaagcaaaaaatctggagcagcagctagagcagataggagcacaaaggaagcagcagcaaaaggaacagctggaacaggaaaagaagctcgtggaccagcacctggatcaagagccagcacagagaactgagcaaccggaaaagaaagaagagcaggtgctggagcagcaggggcagcaggaggggcagctggagcagcctgcctttgtcccagctctggctcaggtccgagngcccctgaagggagaagtcctgcccctcatagagcagcagcaccagaagcaggaggttcatgaccctccagaaca

SEQ ID NO: 10392 - DNA, 429 bp, Canis familiaris
gatgcagcactgaaggtactttatctgcatgataaccagcttctagctggagggctgcatgcagggaaggtcatcaaaggtgaggagatcagtgttgtccccaaccggtctctggatgccaagctgtctccagtcatcctgggcgtccagggaggaagccagtgcctgtcgtgtgggacagggcaggaaccaactctgaaactagagccagtaaacatcatggaactctaccttggtgccaaggaatccaagagcttcaccttctaccggcgggacacggggctcacctccagctttgagtcagctgcctacccaggctggttcctctgcaccgtgcctgaagcagaccagcctctcagacttacccagctctcagaggatgccagctgggacaaccccatcacagacttctacttccagcagtgtgac

SEQ ID NO: 10393 - DNA, 255 bp, Canis familiaris
  misc_feature (48)..(48): n is a, c, g, or t
  misc_feature (135)..(135): n is a, c, g, or t
  misc_feature (181)..(181): n is a, c, g, or t
  misc_feature (186)..(186): n is a, c, g, or t
acaagtcaacatctctgtggtgcagtccaccgtctctggcggctatgntggcgctggtggctttggcggtgccagcggtatgggcagtggctcaggcctgggtggaggcagcggctactcctatggcagcggccntggccttggagctggcttcagttccagcagtggccgaggcgtgggnagtgntttcagctcctctggaggcagcagttccaccatcaaatacaccaccacctcatcctccagcaggaagag

SEQ ID NO: 10394 - DNA, 64 bp, Canis familiaris
caagcaggagattgccgagatcaaccgcatgatccagaggctgagatctgagatcgaccatgtc

SEQ ID NO: 10395 - DNA, 149 bp, Canis familiaris
agtgtcctgggaaagcagtctccatgatgcatcaagaacggaagttcaatttgtctgtcattagagacccacccatgcaggttcttgagctcaagtatcatggtggcataagcatgtacataatgctgcctgagaatgacctatcccaa

SEQ ID NO: 10396 - DNA, 197 bp, Canis familiaris
atcgccaaccgtagccggacggaagctgagtcctggtaccagaccaagtatgaggagctgcagcagacagcaggccgtcacggggatgatctccgcaacaccaagcaagagatctctgagatgaaccggatgatccagaggctgagagccgagattgacaatgtcaagaagcagtgcgccaacctgcagaatgccat

SEQ ID NO: 10397 - DNA, 452 bp, Canis familiaris
gagctattttgctctatgttatagtagatgatgtcaatattttcaaagccacaatatacatcttattttacatctgtagtctatgtgaaattttgatagtctgtagcatgtcaaaatgcagaggtgtaaataaagtcatttacagggactcttttatttctttctcccatttggggaggggggagcttccattaatgatggataatctttccagaaataaagtcaagatgtatttattgaaatatgcttgattatgctggatccaggagtttgaaggaataaaaataattactagttaattaattcaagggaatggtatctgaccaaaagtagcttctgtgtcactttgatttctcatcagaagtgttttttaaagactctggatatcttccaaaaaaattttttagattgtctaacaaatgccagagtgaccatctttaataactgttgtt

SEQ ID NO: 10398 - DNA, 214 bp, Canis familiaris
  misc_feature (81)..(81): n is a, c, g, or t
  misc_feature (91)..(91): n is a, c, g, or t
  misc_feature (107)..(107): n is a, c, g, or t
  misc_feature (111)..(111): n is a, c, g, or t
ggatccagctgctgtgagccttgctgctgcctcccaacgtgctgtcacaccacctgctgcaggaccacatgctgcaagccnacatgctgtntgtccagctgctgccngccnagctgctgtgggtccagtggctgcgggtccagctgctgccagccttgctgctgccgcccaacgtgctgtcacaccacctgctgcaggaccacgtgctgcaagc

SEQ ID NO: 10399 - DNA, 134 bp, Canis familiaris
  misc_feature (36)..(36): n is a, c, g, or t
  misc_feature (45)..(45): n is a, c, g, or t
gaaggacaatcactagactcagagactcagtcaggntcagtccangaacggtccaggtccagtcagaggagacaacgtggcagtagtgcacacggcagttctgagcactcagcatcttatttctaccaggtagc

SEQ ID NO: 10400 - DNA, 447 bp, Canis familiaris
  misc_feature (265)..(265): n is a, c, g, or t
  misc_feature (322)..(322): n is a, c, g, or t
ttaagctggatgttgagcccaccgtggacctgggcagagtgctggaggacatgaggtgccactatgaggccatggtgcagaccagccgcaatgatgtggaggagtggttccaagatcagtctgagagcatcagccagcaggacatgtcctgctctgaggagttgcggtgctgccagtcggagatcctggagctgagacgcacggtgaacgccctggaggtggagcttcaggcccagcacacactgaaagactgtctgcagaactntctgtgtgaagccgatgcccgttttggcacggagctggcgcagatgcagatcctgancagcaacgtggaggagcagctgtctgagatccggggtgacctggagcggcagaaccaggagtaccaggtgctgctggatgtcaaggctcggctggagtgtgagattgccacgtaccggaaacttc

SEQ ID NO: 10401 - DNA, 444 bp, Canis familiaris
  misc_feature (363)..(363): n is a, c, g, or t
  misc_feature (382)..(382): n is a, c, g, or t
agggcaaatacttctccagcaatcccatcatccccagccatagctcttctagttccagcatctaccagtcaggagcttcctcagccattgtgttccagccagtgggctctggtggggtccagccctgtggaggtggctctaaggggccctgctccctctctggttctggagtccacagtagttctagtgtttccagtagttcatctttccatccctgtggtggtgtttcacaggggccctgttccccaccaggcactggcacctttggcggcagctccagctcccaatccagtggcaaaatcatccttcagccctgcggcagcaagtccagttcttctggtcacccttgcatttctgtctccncaacattgagtgggggtcnggatggttctcctcaacctgatccttcagctggtgccaagtcttgcggctctggaaagctcc

SEQ ID NO: 10402 - DNA, 550 bp, Canis familiaris
ctgtggacctaaacaggatgctggaggagatgcggtgtcagtatgagactgtggtggagaccaacctcagggacgtggaggaatggttcaacacacagatggaggagcttaatcaacaggtggccacaagctctgagcagcttcagagctaccagtcggacatcattgatctgagacgcacggtcaacacactggagatcgagctccaggcccagcacagcctgagggactctctggaaaacaccctggcagagactgaggcacgttacagctcccagctggcccagatgcagtgcatgatcaccaacgtggagtcccagctggctgagatccgctgtgacctggagcggcagaaccaggagtataaggtgctgctggacgtcaagcggctggagtgtgagatcaacacgtaccgaggcctgctggagagcgaggattgcaagttgccctctaacccatgctccactcccacctgtcccccttgtgcaccttcccccagtgtgtcccgcaccatctgtgtgccccgcactgtctgtgtgccttgcatgcc

SEQ ID NO: 10403 - DNA, 118 bp, Canis familiaris
acagggatctggtcatgggcactctctagatacctctagacatccagggtatcttcaggatcagagagaaaatcctgggccgtctgattcagtgtttgttcagtctcagaatggtagt

SEQ ID NO: 10404 - DNA, 90 bp, Canis familiaris
acctctagacatccagggtatcttcaggatcagagagaaaatcctgggccgtctgattcagtgtttgttcagtctcagaatggtagtaga

SEQ ID NO: 10405 - DNA, 301 bp, Canis familiaris
  misc_feature (110)..(110): n is a, c, g, or t
  misc_feature (120)..(120): n is a, c, g, or t
  misc_feature (124)..(124): n is a, c, g, or t
  misc_feature (149)..(149): n is a, c, g, or t
  misc_feature (216)..(216): n is a, c, g, or t
  misc_feature (229)..(229): n is a, c, g, or t
acccagctgctgtggatccagctgctgcgagccttgctgctgccgcccaacgtgctgtcacaccacctgctgcaggaccacgtgctgcaagcccgcatgctctgtgtccngctgctgccnaccnagctgctgtgggtccagcggctgcnggtccagctgctgccagccttgctgctgccgcccaacgtgctgtcagaccacctgctgtaggaccangtgctgcaagccngcatgctgtgtgtccagctgctgccagccttgctgctgccgcccaacgtgctgtcagaccacctgctgtagg

SEQ ID NO: 10406 - DNA, 540 bp, Canis familiaris
  misc_feature (260)..(260): n is a, c, g, or t
  misc_feature (272)..(272): n is a, c, g, or t
gacaacctgcgggacactaagaatgagattgctgagctcacccgcactgtccagaggctgcagggcgaggtggatgcagttaagaagcagtgccagcaactgcagactgccatcgcagaagcggagcagcgtggggatatggccctgaaggacgctcagaagaagcttggggacctggacatggccctgcaccaggccaaggaggacctggcccggctgctgcgcgactaccaggctctcatgaacgtcaagctggcccnggacgtggagancgccacctaccgcaagctgctggagagcgaggagagcaggatgtctggagaatgccccagtgcagtcagcatttcggtgaccggcaactccactactgtgtgcggaggcggcgcggcgggcttcgggggtggcatgtcccttggcgggggtgggggtgctggcaagggcggattcggcaccagtgtgggctatggcaccgtcaagggagggcccgtctctgggggcacctccatcctgcggaagaccaccacggtcaagacgtcaagt

SEQ ID NO: 10407 - DNA, 72 bp, Canis familiaris
aacagcgagctggtacaaagtggcaagagcgagatttccgagctccggcgcactgtgcagaacctggagatc

SEQ ID NO: 10408 - DNA, 147 bp, Canis familiaris
gaagaagctgatgggaaatctggatgagaacagtgaccaacaggtggatttccaggagtacgcggtttttctggccctggtcactatcatgtgcaatgacttcttccaggactccccagaccggccctgaagcagagctcttactct

SEQ ID NO: 10409 - DNA, 250 bp, Canis familiaris
atcgtgtgcaccttccaggaatattcaggccgttgcggggacaagcacaagctctgtcaggcagagctcaaggagctgctgcagaaggagctgcctacctggaccccgacggagcttcgagagtgtgactacaataaattcatgagtgtgctggacgccaaccaggactgcgaggtggactttgtggagtacatgcgctccctcgcctgcctctgcacctactgccacgagtatttcaagggctgcgccc

SEQ ID NO: 10410 - DNA, 552 bp, Canis familiaris
gtcatttcaaatctcccaagtgtcctgggaaagcagtctccatgatgcatcaagaacggaagttcaatttgtctgtcattagagacccacccatgcaggttcttgagctcaagtatcatggtggcataagcatgtacataatgctgcctgagaatgacctatcccaaattgaaaacaggctgacctttcagaatctaatggagtggaccaatccaagaaaaatgagctctcagtatgttgaggtgtttcttcctcaattcaagatagagaagaattatgaaatcaaacatcatttaagagccctggggctgaaagacatctttgatgaatccagagctgatctgtctggtatagctgcaggaggccgtctatatgtgtccaaaatggtgcacaagtcctacatagaggtcactgaggagggtacagaggccactgctgctacaggaagtaacattgtagaaaagcagctcccagagtccagggtgttcagagctgatcacccattccttttcatcatcaggaagaatgacatcatcttgtttagtggcaaag

SEQ ID NO: 10411 - DNA, 554 bp, Canis familiaris
  misc_feature (209)..(209): n is a, c, g, or t
aaggtgaaccctatccatattttgtttatggagcatcctgttctgaggttgaagtcgactgtctgactggggctcataagcttcttcggactgacatctacatggatgctgctttcagcataaacccagccctggacattggacagatagaaggagcattcatccaaggcatgggattctataccatagaggaactgaaatattccccngaaggcgtgctttattctcgaagtccagatgactacaaaatccctactgtcactgagataccagaagagatccgtgtcactttggtgcattcccgaaatcccatagccatctactcatccaagggattgggtgaatctggaatgttcttgggatcctctgtgttgttcgccatatatgatgcagtgactgctgcccgtaaagaaagggggctgaccaagaccttctccctgaatagcccagcaactcctgagtggattaggatgacttgtgtggatcagtttactgacatgattcctagagatgatccttcaacatttacaccttggtctatccgtgtgtcttga

SEQ ID NO: 10412 - DNA, 465 bp, Canis familiaris
gcagacatccaacatttgtgacacaagcatgtctgtgggcactcttggtggccaaggagtcaaaacacagcaaagcttcgagatggtcaaaggcggctacactttggattccaacaaaggaggtggccatcagaccttggaatccgtcaagggagcaggacaaggagtaacggatgctggcagatatacatataccgactggcacagcttcacccaacctcggcttggcgaagaatccattagaggacacactctgattaaaaattaaacagtaaaagaaggtgtatctgtgtggacaagacgaggagcataaacattctgaagactacgttcgttcgtataactatgaaggaaaaggatctgtggctggctctgtaggctgctgcagtgatcggcaggaagaagaagggcttgagtttctagatcatctggaacccaaatttaggacgctagcaaagacatgtg

SEQ ID NO: 10413 - DNA, 579 bp, Canis familiaris
gactgagctccggaggacgctccagggcctggagattgaactgcagtcccagctcagcatgaaagcatccctggagagcagcctggaggagaccaaaggccgctactgcatgcagctgtcccagatccaggggctgatcggcaacgtggaggagcagctggcccagctgcgctgtgagatggaacagcagagccaggagtaccaggtgctgctggatgtgaagacaaggctggagcaggagatcgccacctaccgccgcctgctggagggcgaggatgcccacctctcctcccagcaagcatccagccattcctattcttcccacaatgtctcctcctcctcctcatcctcctctggcctccagactcggcccatcctcaaggagcagggctcttccagcttcagccagggccagagctccaagcactgagctgcctgttccagagcctcctgcccgcctaccggccccaacctcctgaaggcctgggccacggccctgctctcccagcgcggtttccagctgtctcccctccccctccgctggtggtgggctaataaagctgactttctggttgatgc

SEQ ID NO: 10414 - DNA, 421 bp, Canis familiaris
gaactacccaggatctttctgtggctcttcctaccccagcaacctgttctgcggcactaacttccgctctcccagaaccttccagttgggatcctctctcaacagtgactgtcaggagatcggctgtgaacctaccggctgccggacgtcctacctggtgtccagcccctgccagacatcctgctacccctcgaggacctccatgctctatggtccctgccagacgacttacactgggtctctgggctttggctccagtggctttcaatcttttggttgtggctctccctctctgggctttggatggagtggtttcccatcagtgggctgtggtcccagtgctttttcatccctgggttgtagatccagcttttaccgtccaacttacctctcttctagaagctgccagtctactgcttac

SEQ ID NO: 10415 - DNA, 192 bp, Canis familiaris
atgcactgcaacaacttctccggtgctgtcttcccaggatgctactggggcagcttcggctaccccctggggtacagcgtgggctgtggctatggcagcacctactccccagtgggctatggcttcggttacggctacaacggctgtggggccttcggctacagaagatactggccatttgatctctactga

SEQ ID NO: 10416 - DNA, 253 bp, Canis familiaris
atgactcgtttcttctgctgtggaagctacttccctggctatccttgctatggaaccaacttccacaggaccttcagagctacccccctgaactgtgtcgtgcccctgggatctcccctgaactatggttatggatgcaatggctacagctccctgggctacagctttggtggtagcaacatgtacaacaggggctgttgctatggtggcagcttttgcaggccatggggctctaactctggcttcggctaca

SEQ ID NO: 10417 - DNA, 205 bp, Canis familiaris
tgccgcccactgcatgatgagtgaatacaacgtgcacatgggcagcgatcagctgagtgataagagagcccagaagattcgggccacgaggtcattccgccaccctggctattccactcagacccacgttaatgacctcatgcttgtgaagctaagtaaacaagccaggttatcatcgagagtgaagaaagtcaacctgccctcc

SEQ ID NO: 10418 - DNA, 562 bp, Canis familiaris
gaagagtgcttcactgcaacagcagatttctgatgatgcaggagcggccaccacagctaggaatgagctgacggagctgaaacgcaatctgcaaaccttggaaatagaacttcagtcagtcatggctacgaaacattcctatgaatgctccctggccgaaacggaaggcaattactgcatccagctccagcaaattcaggaccagattggagctatggaggaagaactgcaacaaattcgcacagagacagaaggccagaagctggagtatgaacagctccttgacatcaaaatatttttagagaaagaaatagaaacgtattgcaaattaatagatggagaagaaagaaaaagcaagtccacatgctacaaatcaaaaggacgtgggcccatacattctgaaaatcaagtcaaagactcaaaagaagaaattgttgtcaaaacagtggttgaggaactagatcaacttggtaatgtcctttcattgagggtccattcagttgaagaaaaatcctctaaaataagcaacattacaatggagcaacgagtgtcttctaaagca

SEQ ID NO: 10419 - DNA, 542 bp, Canis familiaris
gcagcagcagatttctgacgatgctggtgccaccacctcggctcgaaatgaacttacagagatgaaacgtactcttcaaaccctggagatcgagcttcagtccctcttagcaatgaaacactccctggaatgctccctgaccgagaccgaaggcaactactgcacacagctcgcccagatccaggctcagattggagccctggaggagcagctgcaccaggtcagaaccgagacggagggccagaagctggagtatgagcagctcctcgacatcaaggtccacctggaaaaagaaattgagacctactgccgcctgattgatggagaagatggctcttgtgttaaatcaaaaggctatggaggaccaggaaatcagataaaagagtcatctaaaaccaccatggttaaaacaattgttgaagaaatagatcctcgtggcaaagttctctcatccagagttcacactgtagaagagaaatccaccaaagtcaacaacgtgaagagtgaacagtttgaaaatactccagcctctgaatcagatt

SEQ ID NO: 10420 - DNA, 591 bp, Canis familiaris
tacaatcccaactagccctgaaacaatccctggaaggctccttggcagaaacagaaggtcgctactgcgtgcagctctcacagattcaggcccagatctcctctctggaggaacaactgcaacagatccgagctgagacggagtgccagaatgccgagtaccaacaactcctggatatcaagatccgattggagaatgaaattcaaacctaccgcagcctgctagaaggagaaggaagttccggcggcggcggctacggcggcgggcgcggcggcggaagttccggcggcggctacggcggaagttccggcggcggctacggcggaagttccggcggcggcggctacggcggcggaagctccggcggcggcggccacagcggtggtcacagtggtggtcacagcggtagctcgggcggcggctacggcggcggcagcagctccggcgggggcggttacggcgggggcagttccggaggcggcggcagccacggcggtagctcgggcggcggctacggcggcggcagctcctccagcggaggtcacaagtcttcgtcttccgggtcggttggcgagtcctcttctaagggac

SEQ ID NO: 10421 - DNA, 518 bp, Canis familiaris
  misc_feature (337)..(337): n is a, c, g, or t
  misc_feature (381)..(381): n is a, c, g, or t
  misc_feature (399)..(399): n is a, c, g, or t
gagagggttgttggcccaatctctggcactgatttgcatggaatgttagagatgcctgacttgagagatgggtcaaatgttatagtgacagaaagggtaatagcaccaagctcaagtctacccacctctttgactatgcctgatcccagagaatcatcaaatgtggtagtgacagaaagagtaatccgaccagcttctggcatgatgggcaatctaagtatacaccctgagttatcaaatgcccaaaatgtgattgtgacagagagggttgtttctggctctggcataagtggtattagtggcccagctgggataagtggaggcagtggcctagttngcagtgcaatgggagtaagtggtggtggcattgggctgaacagnctgggaggaggtggtggnctgagtagcagcatggggggcacagccaccatcggtcatgtgaggagctcctctgaccatcactttagccagacccttggatctgcctcccctagtactgcccgaagccgaatcacaaa

SEQ ID NO: 10422 - DNA, 222 bp, Canis familiaris
tgccggtgtggagtctgcctgcctagcacctgcccacacacgacttggttactggaaccaacctgctgtgacaactgccccccaccctgccatattcctcagccctgtgtgcccacctgcttcctgctcaactccagccaccctaccccaggcctggagaccctcaacctcacaacctacactcagccctcctgtgagccctgcatctcaagctgctgctga

SEQ ID NO: 10423 - DNA, 216 bp, Canis familiaris
tctgaggaagaaacgaccattggtaattatgcagcaggccctgaggcctttaacgctcaattcctgaacatcgacaagttgcgctctgcttttaagccggatgaattcctgaactggcatgccctctttgagtctatcaaaaggaaacttcctttcctcaactgggatgcctttcctaagctgaagggtttgagaagtgcaactcctgatgcccag

SEQ ID NO: 10424 - DNA, 207 bp, Canis familiaris
tgtcggtgcggagtctgcctgcccagcacctgcccccatgacatcagcctccttcagcccacctgctgcgacacctgccctccaccctgctgtgagcctgacacctatgtgccaacttgctggctgctcaattcttcccacccaactcctggactgagtgggatcaacctgaccacctatgttcagtctggctgtcagaatccctgt

SEQ ID NO: 10425 - DNA, 578 bp, Canis familiaris
taatggaatcactcacgctggaagggaagtggagaaagtttttaatggacttagccacatggggagccaggccggcaaggaactggacaaaggcgtccaggggctcaacagcggcttggacaaggtagcccatgagatcaacagtggcatcggacaagcaggaaaggaagctgagaagtttgtccatggggtcaacaacgctgctggacaggctggaaaggaggcagacaaagtggtccaaggggtccacgatggggtcaaccaggccgggaaggaggcagagaaatttggccaaggggtccaccacgctgctggccaggctggaaaggaggcggagaaacttggccaaggtgtccaccatgctgctggccaggccgggaaggaggtggacaggttgccgcagaatgttcataatggggtcaaccaagccggcaaggaggccaaccagctgctgaatggcgctcatccaggcgtttccaccggccagcaccagcacggagggggcgcaaccaccacgttaacatctggagcttcggtcaacaggcctttcatcagcttcccaactctgtggcaggtga

SEQ ID NO: 10426 - DNA, 295 bp, Canis familiaris
tgcgctgccagattggagaccgcctcaacgtggaggtggatgctgcccccacagtggacctgaaccgtgtgctcaacgagaccaggagtcagtatgaggccctggtggagaccaaccgcagggacgtggaggaatggttcaccacccagactgaggagctgaacaagcaggtggtgtccagctcggagcagctgcagtcctgccaggcagagatcatcgagctgagacgcacggtcaatgccttggagattgagctccaggcccagcacaacctgagggactccctggagaacac

SEQ ID NO: 10427 - DNA, 525 bp, Canis familiaris
  misc_feature (322)..(322): n is a, c, g, or t
gtcccttgggagtcaaatggcatcaagcagtcatttatgtcaatagctgcttgtttgtggctgtgctggtgatactgatcggatgctacatagccatatccaggtacatccataaatccagcaggcaattcataagccagtccagccgaaagcggaaacataaccagagcatcagggtggtggtggcagtgttctttacctgctttctaccctatcacttgtgcaggattcctttcactttcagtcacttagacagactcttagatgaatctgcacacaaaattctgtattactgcaaagaaatgacactcttcttgtctgnatgcaatgtgtgcctggatccaataatttactttttcatgtgtaggtcattttcaagaaggctattcaagaaatcaaatatcagaaccaggagcgaaagcatcaggtcactgcaaagtgtcagaagatcagaagtccgcatatattatgattatacagatgtgtaggagttaaaggcccctaggcctacttgtctgttgaagt

SEQ ID NO: 10428 - DNA, 215 bp, Canis familiaris
atggctgtctcagtgctgcggctgacgatcgtcctgggactactcatcttgatcctgacttgccaggccgatgacaaaccagatgaccagccagatgcctcagacaaaaaaacagagccagaattccccaaattcctaaaccttttgggcacagagatcattgagaatgcagtggagttcatccttcgctccatgacgaggagcacaggatttat

SEQ ID NO: 10429 - DNA, 265 bp, Canis familiaris
agggcatccgagtcggcactgtgatgaggattcggggtgtggtcccgaacaaggctggcaggttctacgtgaacctgctgtgcggcgaggccccggggagcgaggctgcgctgcatttcaatccccgcctggatgagtccaccgtggtcttcaacaccctggagcagggcgcctggggccgcgaggagcgaggcacgggcatccccttccagcgcgggcagcccttcgacgtgctcctcatcgccacggacgaaggcttcaaggc

SEQ ID NO: 10430 - DNA, 240 bp, Canis familiaris
tcttactctgccaagggcctcctggcctacgaggactctagctttcccttttgtattcaataaacttttctgttgatggtattccaattgctcagtgatgccccataccctggtcagcacaattggggtgctggaaaaccagagcctccttagatcctacctcccctgggccctgactcttttctggaaatctcctcaaggccagagctatgccttaggtcccagactttgtgatttcaa

SEQ ID NO: 10431 - DNA, 551 bp, Canis familiaris
  misc_feature (414)..(414): n is a, c, g, or t
agaccgcctcaatgtggaagtggacgcagcccctgccgtggacctgaaccgtgtgctcaacgagaccaggagtcagtatgaggccctggtggagaccaatcgcagggacgtggaggaatggttcaccacccagactgaggagctaaacaagcaggtagtgtccagctcggagcagctgcagtcctgccaggcggagatcattgagctgagacgcacggtcaacgccctggagatcgagctccaggcccaacacaacctgagggactccctggagaacacgctgacagagactgaggcacgctacagctctcagctgggccagttgcagtgcatgatcaccaacgtggagtcccagctggctgagatcaggagtgatctggagcggcagaaccaggagtaccaggtgctgctggntgtgcgggcccggctggagtgtgagatcaacacataccggggtctgctggagagcgaggactgcaagctcccctgcaacccatgtgccaccaccaatgcttgcggcaattcctgtgggtcctgtggcaactctcaaa

SEQ ID NO: 10432 - DNA, 321 bp, Canis familiaris
cactgggacctgttaatggaaacttgctctcgggtctagatcacacatggttgatttgtgcctcttttatgcatgagaattaataatcataataggccttacttcaagttcaaaagtgttttcaggatcctccaagtattttagcattgcctctgaaaacccaacttatcatgaaatgggaattttgctacattgccaaatgcagaggaaactatgtcatagtagtaaagactctgtaaagcaaaattgaaattaaatgtgtttttaaaataaaaatagattaatcttgtctaggaggacctcagattgatttgccatgta

SEQ ID NO: 10433 - DNA, 479 bp, Canis familiaris
ttggcagcaaggtcggaagctccgtgacaggtgtgggcaacatggccgaggagctgcctccagaacaggtggccaagttcaaggaggtcttctccagatttgacaagaacggtgacaacaccatcaacacccaggagctgggcgctgtgatgcaggccctgggccaggatatatcagaggacgagctgaagatgctcatcgcccaggtggacacggacggcgacggggtcatcagcttccaagagttcctggaggcgatggtcaagaggatgaagtcctggggcagtgagcaggagatgcgggaggtcttccgcgcctttgacctgaacggcgacggccacatcagcgtggacgagctcaagcaggccatggccaagctgggcgagttgctgtcccaggaggagctggacaccatgatccaggaggccgatgtggacaaggacgggcaagtgaactacgaagagttcatgcgcatcctc

SEQ ID NO: 10434 - DNA, 378 bp, Canis familiaris
agaccgcctcaatgtggaagtggacgcagcccctgccgtggacctgaaccgtgtgctcaacgagaccaggagtcagtatgaggccctggtggagaccaatcgcagggacgtggaggaatggttcaccacccagactgaggagctaaacaagcaggtagtgtccagctcggagcagctgcagtcctgccaggcggagatcattgagctgagacgcacggtcaacgccctggagatcgagctccaggcccaacacaacctgagggactccctggagaacacgctgacagagactgaggcacgctacagctctcagctgggccagttgcagtgcatgatcaccaacgtggagtcccagctggctgagatcaggagtgatct

SEQ ID NO: 10435 - DNA, 112 bp, Canis familiaris
agaaagcatcgctaatctctgcatacctcccatctttccatccatacaccctcaacaagaaattcacagaaataaggatgttatgaactgtagtcaatttgactttaccttt

SEQ ID NO: 10436 - DNA, 294 bp, Canis familiaris
gtgacctttccatcaaagctcatgtgcacagatgtcaagctcatctcctcccaggactgcaagaaggtttacaaggaccttctgggaaaatccatgttgtgtgctggcatccccaactccaagaccaacgcctgcaatggtgactcagggggaccactgatgtgcaaaggtgccctgcaaggcctggtgtcctggggaactttcccttgtggccaacccaatgacccaggtgtctatacccaagtctgcaagtacaccaactggataaaagagaccatgagaaagcatcgctaa

SEQ ID NO: 10437 - DNA, 78 bp, Canis familiaris
gctgtgggccctgcaacacctttggatgctagatatcccgggaccagcaagaggattgcatgaaaacagaaaggccat

SEQ ID NO: 10438 - DNA, 596 bp, Canis familiaris
  misc_feature (316)..(316): n is a, c, g, or t
  misc_feature (491)..(491): n is a, c, g, or t
  misc_feature (500)..(500): n is a, c, g, or t
gcgctacagcagtccatcagtgatgctgagcagcgtggtgagaatgccctcaaagacgcccagagcaagctggccgagctggaagatgccctgcagaaggccaaggaggacatggcccgcctgctgcgtgactaccaggagctgatgaacaccaaactggccctggatatggagattgccacctacagaacccttctggaaggagaggaaagcaggatgtctggagagtgtgccccgaacgtgagcgtatctgtgaacaccagccacaccaccatcagtggaggcggtggccgaggaggcggcggtttcggctccntaggtggcggcggcggctacggtggtggcagttatggctctggaggtggcagctacggctccggaggtggcggcggtggcagctacggctccggaggtggcggcggcggcggctacggctccagtagcagcagtgggggccacagaggcggctctggagggggcagccggtccgncgggagctncgggggccggggatccagctctgggggcatcaagacctctagtggcagttccagcgtgaagtttgtttccaccagctattccagagcagtcagata

SEQ ID NO: 10439 - DNA, 483 bp, Canis familiaris
  misc_feature (36)..(36): n is a, c, g, or t
  misc_feature (38)..(38): n is a, c, g, or t
  misc_feature (446)..(446): n is a, c, g, or t
gaggccagctctccatctacagcagctccccaccangnaggataaagctctccctcatcaggaggatgaaagtctctgtggctactatctccctcttcctcctcatcatcatcacctgcaccctggagtccaaaactgaattatcctcacgaggaccttaccatccagctgagtgctgcttcaggtacattacccgagcaatcccacgtcaccggatcacagattattttgagaccagcagccagtgctccagggctggaattatcttcatcaccaaaaatggccattccatatgtgccaaccccagtgatgactgggtccaggactacatcaaggacttgaggagaaatgagtgacccagatgtagtggaggagggagcagccagccatcttaaagggaagaggccacagctcccctcttagctgcagccctcagccccagtcanctcttgggagctgccttgccttgaattaaagaccttg

SEQ ID NO: 10440 - DNA, 190 bp, Canis familiaris
gaggaccttaccatccagctgagtgctgcttcaggtacattacccgagcaatcccacgtcaccggatcacagattattttgagaccagcagccagtgctccagggctggaattatcttcatcaccaaaaatggccattccatatgtgccaaccccagtgatgactgggtccaggactacatcaaggactt

SEQ ID NO: 10441 - DNA, 463 bp, Canis familiaris
gaagctggaactttgcagctgccaaggtggtttgccagcaggtgggctgtgggcgggccatactgacccggaaatgctgcaacaaagccacccagggccaagggccgatctggccgagaaaggtgtcatgctcaggaaaagaaatcagcctccaggattgcccttctgaagtttgggaaaagaacaactgcacccacgatgaggacatgtgggtggaatgtgaagatccctttgacttgaagctggtaggaggagacagcccctgtgccgggaggctagaggtgctgcacaagggcgagtggggcactgtctgtgatgatgactggggagaaatggcggaccaggtggtttgcaggcagctgggctgcggggcgtccctctctccatctgtcaaattccggagaagatttggccctggggtcggccgcatctggctggacgacgttgcctgctcagggaatga

SEQ ID NO: 10442 - DNA, 159 bp, Canis familiaris
  misc_feature (51)..(51): n is a, c, g, or t
tcaccgtatgttcaacctgagcaaggctttctcagcttcagtaactggaanacaaattataattgcacatatgccaattaccatgagataagccactctgattgctaaatattctcttacatttcctgatttcctggcatcagaaatcaggaccaattt

SEQ ID NO: 10443 - DNA, 535 bp, Canis familiaris
  misc_feature (351)..(351): n is a, c, g, or t
gaggcaacattcaaccggagatcttcagtactccccagattacaaaaattacctggctttcatcaaccactgctctcatgtcagaggaaattctaactgctatggtgtgctgcctacagaggaacctgtctataattggagaacagtaataaacagtgctgcagacctctattttgaaggaaatattcatcagtctctgccaaacatccccgaaaaccagctggtacaacctgctgttctccatcaaaagggaggaaaaggcaggaagaagctccgactattcgaataccttcatgaatccctgtgcaatcctgagatggcatcttgtattcagtgggtagataaaaccanaggcatctttcagtttgtgtcaaaaaacaaagaaaaacttgcccaactttgggggaaaagaaaaggcaaccggaagaccatgacttaccagaaaatggccagagcactgaggaattatggaagaactggggaaatcaccaaaatccggagaaagctaacttaccagttcagtgaggccattctc

SEQ ID NO: 10444 - DNA, 457 bp, Canis familiaris
  misc_feature (392)..(392): n is a, c, g, or t
aatcgcagtgtggaacggtggcaacgacttgctggccgaccctcacgatgttgaccttttgctttccaagctccccaatctcatttaccacaggaagattcctccttacaatcacttggactttatctgggccatggatgcccctcaagcggtttacaatgaaattgtttccatgatgggaacagataataagtagttctagatttaaggaattattcttttattgttccaaaatacgttcttctctcacacgtggttttctatcatgtttgagacacggtgattgttcccatggttttgatttcagaaatgtgttagcatcaacaatctttccattggtaatttttgaatttaaaatgatttttaaatttggggcatctgggtggctcagncggctaagtcgtctgccttcggcttaagtcatgatctcggggtcctaggatggagccttgtgtct

SEQ ID NO: 10445 - DNA, 553 bp, Canis familiaris
ggtggacatacccatgttttctgtgtacatgagcagtgacccagaaggtggtacgggaagcgaactgattttcggaggctatgaccactcacacttctctgggaacctgaactgggtccccgtcaccaagcaaggctactggcagattgcactggatgcaatccaggtaggaggcacagtgatgttctgctctgagggctgccaggccattgtggacacagggacttctctcatcacaggcccctcagatgaaatcaagcaactgcagaacgccattggggcagagcccatggatggagaatatggggtggagtgtgccaacctcaacgtcatgccagatgtcaccttcatcatcaatggagtctcctacaccctccagccaactgcctataccctactggactatgtggatggaatggagttctgcagcagtggctttcaaggtcttgacatccagcctccagccgggcctctctggatcctgggcgatgtcttcatcaggaagttttactcagtctttgatcgtgggaataaccgtgttgggctggccctg

SEQ ID NO: 10446 - DNA, 48 bp, Canis familiaris
acagctcagctgtggaatcctgtgaatatactaatgatgcaagaatac

SEQ ID NO: 10447 - DNA, 203 bp, Canis familiaris
gtcctgtgggaagcctgccagcagaagacaggggaacacaaaaccatgctgcagatgatcctatgcaacaaaagctatcagcaactctggctggttttccaggaatttcagaatatttctgggcaagacatagtagatgccatcaatgaatgctatgatggatacttccaagagttgctagttgcaattgttctctgtgttcg

SEQ ID NO: 10448 - DNA, 459 bp, Canis familiaris
gaggtttataacatcatcagcccaaacaacaatggtggcaatcttcaggagacggtgtccattgacaatcaaaaaaacatcgccatcgttaacgtccacgcaggatcatgctcctctaccacaatttttgactataaacatggctacatcgcctccagggtgctgtcccgaagagcctgctacatcctgaagatgaaccataaggccatcccctccctggaccagctaaaacggtacacctatgagaaacaggccatgcaaagcatcttctccgataagtacctctgggtcaagtacaacccgctgcagtccctgatcatgcacatagactggttcctgttcggctcgcccatcaaggagctgtgcagtcacgtccccctgtacaagggggaggtgttcgagaagccgcacactgtcggtactggcgtctgttcaaaagtcggattcctgggcatcttt

SEQ ID NO: 10449 - DNA, 520 bp, Canis familiaris
  misc_feature (160)..(160): n is a, c, g, or t
tggacttcttggagtcttcctgaccccagcccttgcttcctccgaaatcaacattggcgggaacagcaacagcggtgcaagtgggcaacagtccgtgagcgtcaacaatgagcataatgtggccaatgtggacaataacaacggatgggactcttggaangccctgtgggactacaacactgtaggtagccaacacgcaatactctttggcaagaagaaatgcattgtgcacagaatgaacaagaatgtcatgccctctcttcagactcttgacacgctggtcaaggaaaagaagcttcagggaaaaggaccagaaggaccacctcccaagggcctgatgtactcagttaaccctgaagaagtcaaagacctaaacaaattaggaaaacccatcgctaacatgtgcagggggattccaacatacatggccgaggagattgaaggagcaagccttttctttacttcaggaaagtgcttcagtgctgatatattatggattctgaacatttcctactgtagc

SEQ ID NO: 10450 - DNA, 568 bp, Canis familiaris
gaacaggatcctggtgatcgccatcgtgttccaggtctgcatcggctgcttcctgtgctactgccccggaatgcccaacatcttcaacttcatgcccattcggtaccagtggtggctggtccccatgccctttggcctcctcatcttcgtctatgatgagattcggaaacttggagttcgctgttgcccagggagctggtgggatcaggagctctactattagaggaaccatccctgcaccccccgcagcagaggtggggggcatgggacccgctgggccgccactggaacatcaaagcgaccaggagccctggcacctgtgtcagctcctgcagcccacggcgccccgaccttggagggccctccccgctccccttccccatccacagagagcccaccccgtcagggcggtccctgggccaggtcctggtctgaagagtggggagggggggtgttggcaggagtggggcgctggctgttcctgtgaggcgggtctgcactcggggtgcccagagggctccccagggtactgcttcaatacacacctgtgccgcgtgatagtaataaa

SEQ ID NO: 10451 - DNA, 154 bp, Canis familiaris
ccccatgacccctatgaagggaaagtggagttcaagctcaccattcagcagtagagagcaaggaggctgcaccctggcccccatgacccctatgaagggaaagtggagttcaagctcaccattcagcagtagagagcaaggaggctgcaccctg

SEQ ID NO: 10452 - DNA, 272 bp, Canis familiaris
gagaggacgctcacgccaccatggagcacagggtgatctacgtcctggtgttggtctgtgcactgaccctcagctccctggcccagggccagcaggagacgtgcacggtggcccctcaccacagagacaactgcggctctccgggcatcacgccttcccagtgtaaggacaagggctgctgtttcgacaacacagttcgtggggtcccgtggtgctactaccctgtggccgtggacaaccctcccgaagaggagtgtcccttctagatgcct

SEQ ID NO: 10453 - DNA, 367 bp, Canis familiaris
gtcccgaacaccagaaactacagcagagaaaggagtccaagaagccgccggccaaactgcagccccgagccctagaaggctcccttggcccagaagacacaagtcaagtggaagaggcagaggatgagctggaaatccggttcaatgccccctttgatgttggaatcaagctgtcagggcctcagtaccaccagcatggccaggcactcgggaagtttcttcaagaggttctttgggaagacaccaacgaggccctggcagacgagtgatcatccacaagatgggcctgcctgttctccccccaccctagaagcactcacctgacttttacactgtttctgcagctactcccagttctgagtggtac

SEQ ID NO: 10454 - DNA, 66 bp, Canis familiaris
cagcaggagggagatatgcctactttagccaatctgacacagaccctggaagatgtcttcaaaaag

SEQ ID NO: 10455 - DNA, 66 bp, Canis familiaris; identical to SEQ ID NO: 10454

SEQ ID NO: 10456 - DNA, 434 bp, Canis familiaris
  misc_feature (347)..(347): n is a, c, g, or t
catctgatgaggaatatggtcggcatagaaaacatcatcatagaggacgctctgaaaatttttattatcagcaatatccaaaatttcagagatattatgatgataaataaccttataatgctacacaggaatccacaacaggattacagaggcttcatggaaagtcctacttgctctcttactcatgatgattcttcctattcaaaaatcctttaaacatctagtaacattaaccccaatacaatacatacacccaaagtacttataaaatcatgttttaaagtataattcaaaaaagtacagttttatttttattatgttatatattatattggaatttaaaagtnatttgacttatcaataatttctagcttttcagaaacaaaaaagaaatccaatcaaatagtgttatagcagcaacacacactgagatt

SEQ ID NO: 10457 - DNA, 540 bp, Canis familiaris
  misc_feature (30)..(30): n is a, c, g, or t
  misc_feature (32)..(32): n is a, c, g, or t
  misc_feature (48)..(48): n is a, c, g, or t
  misc_feature (54)..(54): n is a, c, g, or t
  misc_feature (71)..(72): n is a, c, g, or t
  misc_feature (75)..(77): n is a, c, g, or t
  misc_feature (152)..(153): n is a, c, g, or t
  misc_feature (356)..(356): n is a, c, g, or t
  misc_feature (370)..(370): n is a, c, g, or t
  misc_feature (386)..(386): n is a, c, g, or t
  misc_feature (464)..(464): n is a, c, g, or t
  misc_feature (493)..(493): n is a, c, g, or t
agagaatcttctttaccgtccatatccacnantttatccttaccctcnatatcnaccagtttatccttacnntcnnncatatcaaccagtttatccttacaatgccccagaacaataccctccttcttcttagccatcattttgaatattannaaccctaggacatgattatggcggcttggtggaaagtcctatttgctttcttactcaaaatgattcttcctaaagaaaaatcctttaatcatctagtaacacttattagccccaatataccacatacacccaaagtatttgtaaaattatgttttggaatttaattttttaacaatacagttttatttgcattatattatgcnttatatcacaattnaaaaataattggatcnatcataatttctagattttccgtaagaaaaaagaaatctaatcaaataatgttacatggacaacacacaccagagatnaatgatcaatattttgaaaatagtaatangtagtctctgaactattggaaaatctccttttctcctctgtgttaat

SEQ ID NO: 10458 - DNA, 523 bp, Canis familiaris
  misc_feature (298)..(298): n is a, c, g, or t
  misc_feature (342)..(342): n is a, c, g, or t
cgtccattggtttgtgctggtacatcatgtccggctctccagcatacagacttggaagcttgagaattccatattggatcaccagaataagaccctccacagtgactaccgcaggatccagcccctgaatggcagagtggtggaaaccaactttgtgaatctccctagtcagggttctgagttccagttttacgtaaataagctcaacaataagcttgaatacttgagaagacttctcgaaaagacgaaagtggaaaaaaaaccgcacatacaccaagcttgaagggagagatgtgtnggaggaagaggtggccctcccccagctctgagaaatcctacgtngggatctcagccttcccctaggctcctgtttagtttctgattaagaccatcatccgtgagcagacgtgagatggtttaagggtatgagaaggggtttgtgagacgacaataatgggaattgattggaatagaaatttaaaggaaatggagccctgcctaccttcctatcgaatcatgcatg

SEQ ID NO: 10459 - DNA, 448 bp, Canis familiaris
acgatttgggtctgcaccggaagtgcctttgctgccgatgtggtacctactgaccgcggtttcagtcgctctccctcgttttcctcgctggctgtttgcgtcgcgctatggcgcccaagggcaaagtgggcaccagagggaagaagcagatatttgaagagaacagagagactctgaagttctatctgcggatcatactgggggccaatgccatttactgtcttgtgaccttggtgttcttctattcatctgcctcattttgggcctggatggccttgggctttagtctggcagtatatggggccagctaccactctatgagctcgatggcacgggcagccttttctgaggatggggccctgatggatggtggaatggacctcaacatggagcagggcatggcagagtgagtgtcccccgctgccagcccagggcaccttaaggatgt

SEQ ID NO: 10460 - DNA, 486 bp, Canis familiaris
  misc_feature (357)..(357): n is a, c, g, or t
ctggacggtgattcagagccgcgactggggccgcgggaggcccctggactttgagaggtgctggcaggagtacaagcagggcttcggagacttgagaggtgaccactggctggggctgcagcacatctctgacctgacgtcccagccgggcctgcgcgcagagctgagggtggacctcctggacgtggacaaccgcacgctgcacgcccattacaaccatttccacgtggatggggaggcccagttttaccggctgaccctgggcctgtactcggggaacgcaggggacgcgttccggggctcgggccacacagacaaccaggagggctgcggcttcagcacgctagaccgcgatcntgaccgctgctctccctgcacggacggtgcccagaccttctccagctgcagccacgatcgctcgggctccgggtggtggtacagcgactgcggccacgctgacctcaacgggccatggccagagcgtga

SEQ ID NO: 10461 - DNA, 592 bp, Canis familiaris
  misc_feature (413)..(413): n is a, c, g, or t
  misc_feature (564)..(564): n is a, c, g, or t
tcaaaacactgtcaccttaagcggtgaagaatccaatgagatgttccaggtcaacggtgacaatcgcttactggtccagcgttctgaactaacaaaagcacatggacaatacacactagatgtggaaggacaaggttgtgcatttatccaggttaccctgaggaataatgtactattacctaaaaaagcatctggattttccctttccttggaaataatcaagaaaaactcttcagatacatttcagagatattttgacctgatagtaaccctcaagtatactggaattcacaataactccaatatggtccttgttgatgtaaaaatgctgtcaggatttactccagtcatggcatccattgagaagcttgaaaacaatggccaagtgatgaagactgaagtcaagaatgacnatgttcttttctacttggaaactgtttttgggacagcaaaccactttactttcagtgttgagcaaaccaaccttgtgtccaacattcagccagccccagttatggtctatgattattatgaaaaagatgaatatgcccttgtttcttacantatcaatagtgtttcagcttcccagtaa

SEQ ID NO: 10462 - DNA, 376 bp, Canis familiaris
aatcttctccaagtgtgagctggcccgcaagctgaagagcatgggaatggatggcttccatggctacagcctggcaaactgggtctgcatggctgagtatgagagtaacttcaacacccaggcctttaatgggagaaattccaatggcagtagtgactatggaatcttccagctgaacagcaagtggtggtgcaaaagcaactctcactcctcggcaaatgcctgcaacataatgtgcagcaagttcctggatgacaacatcgatgatgatatcgcctgtgccaagagggttgtgaaagatcctaatgggatgtctgcctgggtggcctgggttaaacactgcaaaggcaaagatttgtccaaatacctggccagc

SEQ ID NO: 10463 - DNA, 462 bp, Canis familiaris
ccatgtgactcaaacccatactgtaaaacctgggctgtgcaaaaatgtgagatcatccgggacagcattttcaaagaatgtcaccacaaggtggaccccgaagcttacttagaagcatgtattgaagaagcctgtgcatgtgacacgcaggggaagtacttgggattctgcacagctgtggctatgtacgcagaggcatgcagcgcagttggagtctgtgtcacatggagaaaaccagatctctgtcctgtcttctgtgattattataacgaacctggggaatgcagttggcgctatgaaccttgtggtacagtgactacaaaaacatgcagagacaaagttattggccagaaattttctgcagttttagaaggttgttatgctaaatgcccggataatgctccttatctggatgagaacctcatgaaatgcgtcactttatctgagtgcagctgcttctat

SEQ ID NO: 10464 - DNA, 45 bp, Canis familiaris
cagagcaggaaccactctaggtcctcggagtgaaccttctgggac

SEQ ID NO: 10465 - DNA, 407 bp, Canis familiaris
aagtccgatctgatcaaaccctgggggcacttcagggttttcatccacagcatgagcgcaaaggacggcaacctgcacggggatatccttataccgcaggacggccagtgcgagaaagtctccctcactgcgttcaagactgccaccagcaacaaatttgacctggagtactggggacacaatgacctgtacctggcagaggtagaccccaagagctacctgattctctacatgatcaaccagtacaacgatgacaccagcctggtggctcacttgatggtccgggacctcagcaggcagcaggacttcctgccggcattcgaatctgtatgtgaagacatcggtctgcacaaggaccagattgtggttctgagcgatgacgatcgctgccagggttccagagacta

SEQ ID NO: 10466 - DNA, 511 bp, Canis familiaris
attgctttgcctgaatggatctgtaccatatttcataccagtggttatgatacacaaaccatagtcaataacaatggtggcacagactatggacttttccagatcagcaataaattttggtgcaaggacgaccagaaccttcagtcaaggaacatctgtgacatctcctgtgacaagttcctggatgatgaccttactgatgacatgatttgtgccaagaagatcctggataaggaaggaattgactactggttggcccataaaccactctgctctgagaagctggagcagtggcgctgtgagaagttgtgagtgcctgctgtcactggtgcttctgcttctgtatgttcctggaatgcctcttccctaaggctacctcagtttgcttctttcttcttccttgaagctgatttgtctctgaatcctgagctctgtggtgacaccactggacacttgaggactattctccagcaatgcatggctggtacactggacttttgacccttgttca

SEQ ID NO: 10467 - DNA, 317 bp, Canis familiaris
  misc_feature (60)..(60): n is a, c, g, or t
  misc_feature (92)..(92): n is a, c, g, or t
gaaaacgttccagcggtttgctgtcttcggagaatcctcgagcagcggcactgaaatgancaacaaaaacttctccaagctctgcagggacngtggcatcatggacggcaagacggtcacctccactgatgtggacatcgtattcagcaaagtcaaggccaagaatgcccgaaccatcacatttcagcagttccaggaggccatgaaagaactgggccagaagcgattcaaggacaagaagccagatgaagctctggagaacatttataagctcatggagggcaaggatccagctaccactggtgttaccaaagcaa

SEQ ID NO: 10468 - DNA, 528 bp, Canis familiaris
tatagactccctcatgttcaagaagaaaatatcaaacttaggaacaacatggagcagttactacaggaagcagaacactggaatgtgcaacatgctgagctcagtgaactaataagaacatatcagaaatctcagaaagatatacaagaaactcttaaaaataatggagcacatttccaaactcaatcaaatgagaaggtgtcagctcagcatgaactggaggaacaagtgaaaaaactggaacatgacacatattcattgcatttgatttcagctttgctggaaaatgaatgtcagatcttacagcagagaatagagcttctcaaggaactccatcatcagaaagagggaactctgcaagagaagccaattcagaaaaacggtgaaaaggacaagaaaaaacagaagctatcagcagagcataagccaaaaatgcaagaaaaagagggtacatttcagaaaaaagacaaattctacagaggcctggatgctggtagcaagaaagcgcttaataaccacttcaatact

SEQ ID NO: 10469 - DNA, 409 bp, Canis familiaris
  misc_feature (44)..(44): n is a, c, g, or t
  misc_feature (54)..(54): n is a, c, g, or t
  misc_feature (90)..(90): n is a, c, g, or t
  misc_feature (93)..(94): n is a, c, g, or t
  misc_feature (222)..(222): n is a, c, g, or t
  misc_feature (272)..(272): n is a, c, g, or t
gacttgaaatctgcttttcctacttttctctattgcctcccagncagaaacagnagaagtgaagggcagaagtgccaacatgtagcatgnccnncctgcatcatggggttctgagttgggtccgagtcccagtgccctcacacctggctacctcacaaaggagtctccgggccagctcaggggaagctgccaagagatttggtcctcagaaaggagacaganctgcatcaatcaaattagtatttattcagtgctgacgtgcccagagctgntgataggccagcaagaaaccctggtccctgtcaccaatttgtttataatctcactaaacagagatggactcacataaaatgctttgtaagcaatccactaagatttaactgaaggccagcccagaatgggtacttaa

SEQ ID NO: 10470 - DNA, 416 bp, Canis familiaris
  misc_feature (32)..(32): n is a, c, g, or t
atccagccacgttgtttgggacaccgccgcgnttctcttttcatcacccttacttcctacctggaccgcactatttcccatcaagcacgtgcccttatagtcggcctccctttggctatggaaattttccaagttcaatgccagaatgccttggttattatgaagacagataccaaaaacatgaggctatgttttcagctttaaatagagactatccttttagagactacccagatgaacgtacacacagtgaagattctcggagttgtgaaagcatggatgggacctcttactataatagtcatagtcacagtggggaagaatacttaaatcccatgcctcagctggacattggagccttggagaatgtcttcacagccccaacatcaacttcctctagcatccagcaagtcaat

SEQ ID NO: 10471 - DNA, 388 bp, Canis familiaris
  misc_feature (174)..(174): n is a, c, g, or t
atcctttcattgtatcctcgatccaggatctggaatcccgcgtcccagggccgaggaggaggagcaatcctcccgaagcccagtcacttcctcgcctaaaagaggggagtgctcagagagaacgtagagttgcctttaatcctagagctctggatgaacaacggaaacagcctntgctctgaagaagtttgagccccaccctgtccttgaagaccttcggatgtcaagctttctctgtccacattgtgactgatgcaatgacccaagttccccaccatattgcagtagaggaatgggagacggttccacccactgcacagcatcctcttcccccctacagagtaagacctgccccacacatctcctcacctccatgtagtatttttca

SEQ ID NO: 10472 - DNA, 528 bp, Canis familiaris
  misc_feature (49)..(49): n is a, c, g, or t
ggtgcagctcccaagagtggcagtacctttaccagctgaccaggagacnattggagaaacaactcctacatgtcccttatagcctggaatatattcaatttgttcctctgctcaacctgaagccctttgccccggagctccagctgtccgtactcttgctgagagttttccagtttctctgcagccagagttgtcgtaactggcttcctatagaaggctggagccatgtagtcaggcttctctgtaacagtctgaccaatctcctggactccgttaggatgatacagtcagttggcccttgggctcaaggacaagaacaggacctgacccaggaaaccctgtttttttatacccaggtattctgtcacgttctgcacatcatggccatgctcccccacgaggtgtgcgagccgctgtatgtcttggccttggaaatcctcacctgctatgaaaccctaagcaaggctaatccttctagtagttccctgctccagaaggtaaatgagcagcgcttcttaaagtccatcg

SEQ ID NO: 10473 - DNA, 234 bp, Canis familiaris
aaatgattgctttaaaacaccacgataccaatcttatattgtacttgctctaaaatgattaaacaattttcacatatatttttaatagctatatgttcattttctaaatgacataatttacaggaaattttataattttggatccctaaaaattgaataaattcccagatgttatttattttataaataattgtctgctatgtattatagtccctgtctaagcagtaaaaatcc

SEQ ID NO: 10474 - DNA, 225 bp, Canis familiaris
gtcgcagtctctaagttaccagggcatctcgtgggcatccatctgcagccccaagcagtatgtagtatgtggagaagagatccagatgtcacctccatgagcatcaacagaagcaagaagagcactgctttgagaggggtagtttcgagtgtgggacagaggatggagttcattgccttcagatctggactttaatcccagttctcttgctcctctttgaataaa

SEQ ID NO: 10475 - DNA, 430 bp, Canis familiaris
  misc_feature (38)..(39): n is a, c, g, or t
aatgtttatctagtccaaccccatcagctcacagagtnnagctgtacttcagaaaagtcaagggcctttcccaaggttgcatatgggtgtaactgattttctacctgaatcttgaactctggccttcttgcccagcactctccattatgggttggctctagatttatttcatttgttcataaacgttttccaagtgctgactatatgcagctgttatgtggcatcctggggacctcgcaaagaacaagacagatgtaggggtccctggcctcctggaagatgcctagtaaaccaggagtgcatagcgagcatcatggctctggcatgtgcggtgaaggaggagtggcggctgctccgccgtggacatcggggagagggacaaaggagaggcttccctaaggatgggatgttgaaggctcccagcagcgac

SEQ ID NO: 10476 - DNA, 544 bp, Canis familiaris
  misc_feature (99)..(99): n is a, c, g, or t
  misc_feature (374)..(374): n is a, c, g, or t
ggatttgttgtcagtgaaggcatcaaaaactttttacttgctgaggtacaaacacatgacccaacacttggacagtggagtacctttgggactctggangttgcagctcagactgaatcagaaacaaaggagtactcggtgatcacagaagaagactgtgaaattcttaaaatctctgcaaagaattatgcgaggttaaaatcggaaaaaataaaacttgaaaataagcaaaaggtgaaattaattcgtaaatgtccatattatgaagaatggcctactttatccatatatgaattagttgcactcattaaatggaaaaaatttccaccaggtcacatgatagtggaaagtggaaagataatttcttttgtggnctatatcaattctggatattgtaacatttatagaaatattgtaggacttacgaaactagaaccaaaaaaagcgaaaaaaattaaaaaacttgtttgtatgggtaaacttaaggaaaaggagtcctttggtgagattagtgttcttcttcaagttcctttcacatgtacta

SEQ ID NO: 10477 - DNA, 46 bp, Canis familiaris
gaaggtatggccgttgtctttgagtgggaatgcccagccacccctg

SEQ ID NO: 10478 - DNA, 373 bp, Canis familiaris
  misc_feature (86)..(86): n is a, c, g, or t
gtgcagttgatgactcagaccctaaaactggaatctaaagagagctgtgaagatctcctggttccagatccagtgtcagaatttanacttcatcggaagtaccgggatacgctgatacttcatggaaaagttgtggaagaagctgaggaccttcattttaaacaactaccttccgctgtcatgccaggttctgaaaagatcagaagaatagttgaagtcttgagagctgatgtaatccagggcctgggaattcagcttttagaacaagtgtatgatcttttggaagaagaggatgaattgcagagagaggtacgtttgcaggagcacatgggtgaaaaatatacaacttacagtgtgaaagctcgccagttga

SEQ ID NO: 10479 - DNA, 490 bp, Canis familiaris
tagctaagcgctagctgtgatggcaggaggcccccctactatcaaggaggagatggaaccatccatcgctgaagagctggttcctggaaactatgggaaaagccaggagcacctggtgatagcagaaatgatggagcatggatcccagtctgtgggtgcttctcagcggcgacagaaggcggatccaaaggctgctggctctgctgcaggtcaatcgggttggaatatgactggcaaccggagcaagaaagcggggccccagcagcccttagcagcatcagagccattgtccacctctcccccgctggcctggggaggcctgtgctgccgggaggtcggaaaagggcagcgtcctgctggcccatcagcgctccatgatcaccatctgagagctgaaccttgccaatgcgccctcggtgtcccttccgctccatcgtctgtggcagggccctggctgcgccttcccagttttcttccactttgtgtacgg

SEQ ID NO: 10480 - DNA, 489 bp, Canis familiaris
gtccagggatgagaacaaggctcttagaaaagaaaacaaatccctctggggagaaaataaagctcttcgacgagaaaacaaagccttccgaatggaccagttgatcccggaggtaaatcagtccttgagagagcaaaacgaggtcctatggaagtttaaaaatgtgatcttagagagccaaaatccagcaggggaaaaaatcaatgctttgaacacagaaagaaagttttattggcaacagaatcgaggcctaaaagctcagatcaaggctctcagagaacaggagaaggcctttcagactgaggcaaaagctcttcaggaagaaataaggtctctccatgaggagataaaagccttgaaacaccaggagagagcaatcaagatggaggaacaagccctgatgaaagaaggaatagcaatagagatggaagaaaaagctctgtgggaggaggcacaggctcttcgtgaggagaacatggctcttagaga

SEQ ID NO: 10481 - DNA, 260 bp, Canis familiaris
  misc_feature (32)..(32): n is a, c, g, or t
  misc_feature (127)..(127): n is a, c, g, or t
tcaccaggagattaacccgtcaggccgccaantgagaagggacagagcgacaggaggcccgggatgcaaggaaaatcaaaacaaatccacctgctcagagaagactatgttgacaccccaccccccngcagatctctgtggcaagtgctgtcgcagccacggatgtggcactgggtcatttatgactgcctcatgacattatttttcactgttgtctttgcattgttctttaatgactttgtctaatggtctcttctcac

SEQ ID NO: 10482 - DNA, 165 bp, Canis familiaris
gaaggcactcttcatgttattccgatgggcagagtttatatttggaagaaaatggaaatcacgaatctccctaccttgcgagcagctctgtagaaattggtctagaaaattctgaactgtataaagatttatctgactccatcgagcaaacctttcagagaacaa

SEQ ID NO: 10483 - DNA, 273 bp, Canis familiaris
  misc_feature (39)..(39): n is a, c, g, or t
  misc_feature (107)..(107): n is a, c, g, or t
ttctggctgatgacaagcgtctctccgactactgcatcngggcccaatgcctccatcaatgtcattatgcggcccttggcaaagacggcagctgcagaggcccaccnagccacagcctttgtggcaccatctgggcctggtcctggccaaacactttgagccccacgacaccaaggcagtgctgcagctgctgaggcgggagcatcaggagcgcctgcagaagataagcctgggggacctggagcagctggcacagtacctcctgctgcagga

SEQ ID NO: 10484 - DNA, 443 bp, Canis familiaris
  misc_feature (396)..(396): n is a, c, g, or t
gttacttccctgtgaagtctgtggaagacgctttgcagcagatgttctggaaaggcatggaccaatatgtaggaaactcttcaacaaaaaacgcaaacctttcaattccctgaaacaaagattacagggcactgacatccccattgtgaaaaaagctcctcagtccaagcctcaatctatgagaagatctaattggagacaacaacatgaagacctcattaatgccatccgatcggcaaagcagtgtacactagccattaaagaaggccgacctctcccccctccacctcctccatctgtcaacccagattatattcaatgtccatattgcatgaggaggtttaatgaaactgcagccaaccgacatattaacttctgcaaggatcagtcttctcnccgagtctttgatccagcccaaacagcaggcaaattggcatccagag

SEQ ID NO: 10485 - DNA, 529 bp, Canis familiaris
aaagtctcccagctgttgctccgagccatcactgcgcacaaagggctgacccttgctgccctcaagaaggagtttggaaatgctggctacgaagtgcgcaggaagtgctgccgcccctcgggcgaagcacccaagtctgatgtgaagggcacgcttctgcgggtcagcggcagggacgcctcgggctacttcagggtctggaagactccgaagcccaagagaaagccaggacgcccgaggttggcggagggcgcgcgctcttcgcggaggagccttccggcgccgcggagcccacggaggcgcagcacgcatcgcagggcggccaagaaggccagggaagtatggagacggagcaccagggcaaacgcgagggtgcggaagataagggcaagagccaaggactcggtgcgttccagagccagggaggaagcgagggctaaggtgatggaggagaggaaaggacggaccctgaaggaagacaacaggcctaggacccgggaagagaggagcaggccaggcttgaagccca

SEQ ID NO: 10486 - DNA, 354 bp, Canis familiaris
  misc_feature (41)..(41): n is a, c, g, or t
  misc_feature (78)..(78): n is a, c, g, or t
  misc_feature (136)..(136): n is a, c, g, or t
  misc_feature (138)..(138): n is a, c, g, or t
  misc_feature (156)..(156): n is a, c, g, or t
ctcgcgtgactatataggcaagcatttggagactacctttnctttggtatcctagccctcagtagctcaaggttggcnttctgagcagataaataggcttttaagtagcaaagttccctgctctcagcaagcctgncnccatggggaagggagacnccttggagatagcaccaaccccctctgcctaccgctctgtaatggaggagtacggttacgagatgggcaaggtcattggcaatggctcctatgggacggtgtacgaagcttactacacaaagcaaaaggtcatggtggctgtcaagatcatctcaaagaagaaggcctctgaggactatcttaacaagttcctgcccc

SEQ ID NO: 10487 - DNA, 375 bp, Canis familiaris
  misc_feature (62)..(62): n is a, c, g, or t
ggaaaatatgtgtaggaaccctcaatgtgaaaagtgtactccacgtgtgtatttgagtcagnccggcaggatctgcagccgaagagatggagacgcacagtagaagtcaaggacttgaggctgtctttgaagtctgcagcagagccccagactgaagcagcgagatgcatctgctaatagaattcctgtctcagaggtgccctgctgccatccagcatccagccggcactcggagtctggctctattgatagatgaataagattgaacatgacacctgtgtccagtgaatcccctggcaccatttaactaactcttagagcagctgcttttgagaaattaccttcagtcttgggcccaccctagcagaacaaaat

SEQ ID NO: 10488 - DNA, 421 bp, Canis familiaris
  misc_feature (40)..(40): n is a, c, g, or t
  misc_feature (46)..(46): n is a, c, g, or t
  misc_feature (58)..(59): n is a, c, g, or t
  misc_feature (68)..(68): n is a, c, g, or t
  misc_feature (79)..(79): n is a, c, g, or t
  misc_feature (82)..(82): n is a, c, g, or t
gggttgcctgtggagctcaatcagctcaagaatatccgtnccctgnacctaggcttgnnccatctggncagtgtgcccnccnctctgggtgctctgaaggagcttcatgaggtagggctacatgacaacctgctgaccagcatccccaacagcatctctaaactccccaagctcaaaaagctcaacataaagcgaaacccttttcccaagacagaggagtcagatatatttctagataccatcaagaggctggacaacttatatctggtagaggataaggatttgtgttcaaattgcctgaaaaagtgccaacaggcccgggacaagctgaacaaaatcaagaatatggccacagcaactccaagaaaggccatcttttccaatctggtctctcccaactccatggccaaggattcccagg

SEQ ID NO: 10489 - DNA, 188 bp, Canis familiaris
tgaacttcaacttagctacaatcggctcctttctctacctgaagagattaagttcttgaagaagctccagaaacttgtcctgattaggaacaacattgaagttttgccagagggacttcgtgatcttcagaatttaagaatcctagacatagctggaaatattattcagatacttccatcaggatttc

SEQ ID NO: 10490 - DNA, 87 bp, Canis familiaris
  misc_feature (56)..(56): n is a, c, g, or t
ctgaccctgaggcaggaagggaaaagggaggaagggaagaaggcagggggctatanctacagggaattctgggatctcctattcccg

SEQ ID NO: 10491 - DNA, 441 bp, Canis familiaris
  misc_feature (53)..(53): n is a, c, g, or t
  misc_feature (126)..(126): n is a, c, g, or t
  misc_feature (362)..(362): n is a, c, g, or t
gagaactcttggctatgcacggatgccacgtgaagacctcattaagtgtttgnaaacccaagctccaagttcagggccacacgtctgttttccactcaaaggaagtacagctaatgggggcttgancattccttagaggatttcaagcctttaattactcattttcaggaaattacttgttctctggaagaaacaacattttgctttgaatctagctacacgaaagctggaccagggaagaggtgtggtctccataggggacccgcagaacacaagagaccaaatcctgagtgattgagcaacgcctgtttccagaggtgggtggtcaggggaatggatttcgctgggacttcaggcctgcntctgtcaagagttctataaacaagcccaggttcccatatcttctattgtcccctggctcccctccttgtgttaggatag

SEQ ID NO: 10492 - DNA, 257 bp, Canis familiaris
  misc_feature (44)..(44): n is a, c, g, or t
  misc_feature (46)..(46): n is a, c, g, or t
  misc_feature (76)..(76): n is a, c, g, or t
  misc_feature (153)..(153): n is a, c, g, or t
ggacatttgtatatcactctcagcatgatttttatgaagcatgncnacgtaaaacaaaaagataagatcttggacncccggggctcagaatctaagattaaagaatccaaatgccatagcaaataggaaatggagcccagaagtgttctgtgnctggcccagaatcagcagtggtatggaggctgataggattggattaaaaaacttctcacctaggaatgtcttccttgtccttcactaaccaaagaactcgtcac

SEQ ID NO: 10493 - DNA, 479 bp, Canis familiaris
gaatcagatcgacgtcacagcaaaggatgtaattgcaaacgatcaggatgtcttaaaaactactgtgaatgctatgaggcaaaaattatgtgttcctcaatatgcaaatgtgttggctgtaagaattttgaagaaagcccagaaagaaagacactgatgcacttggcagatgcagctgaagtaagggtacagcaacaaacagcagcgaaaacgaagttatcttctcaaatttcagacttgcttactaggccaacaccagctttgaatagcggaggaggaaaattgccatttacatttgtaacgaaggaagtagcggaagccacgtgtaattgccttcttgcccaggcagagcaagcagacaagaagggaaaatcaaaggcagcagccgaacggatgatacttgaggaatttggacgatgtttgatgagcgtcatcaactctgcaggaaaagcaaaaagtgacccttgtgccatgaattg

SEQ ID NO: 10494 - DNA, 337 bp, Canis familiaris
ggacatcctttttcaaatctgctatggaatgtatggttttatggatctagtgtgcataggtctcattgtccacgaaggagctgcagtttacagagtatttaagcgctggcgagctgttaacttacactgggatgtattaaattatgataaagccacagacatcgaagaaagtagccggggagagtcttccacaagcaggactttatggttgccattgacggctctacggaacaggaacttggtccacccaacccagttgacctccccgaggtttcagtgtggctatgtgttattgcatctgttcaatcggatgaggccccgtgaagatttgtcagaa

SEQ ID NO: 10495 - DNA, 129 bp, Canis familiaris
gtgacttctgtgtgacaaaagtgtaaggcggcttggtgtagaccaccctgcacatgttggaatgtaattgcaatgaatggcgaaaccatagcacttctaaaaacatacatctatgaactttttaaaatt

SEQ ID NO: 10496 - DNA, 193 bp, Canis familiaris
  misc_feature (76)..(77): n is a, c, g, or t
acgagcgccgcgtcaagctcactgactttggctttggtcgccaggcacacggttatcctgacctaagcaccacctnnttcggctccgccgcctacgcgtcgcctgaggttctcttgggtatcccatacgaccccaagaagtacgacgtgtggagcctgggcgtcgtgctctacgtcatggtcaccgggtgcat

SEQ ID NO: 10497 - DNA, 150 bp, Canis familiaris
ggcctcacggctgcgttggaagtccgcgcttctcacacttgcggtgcggatgcgtacgggaagcccggggatcttgttaaaatgaggactcccattccgttggtcagaggcgcagcctgttgttaaaaactcccaggtttgcatcgccag

SEQ ID NO: 10498 - DNA, 270 bp, Canis familiaris
gaccgcacacacgtgggagttcacatttttggcttattcatcgagggagccaggtggaatcatgaacaaaatgcactagaagactcgctgcctcgtgagctatgctgcgattttcctgaaatctatttcttgccaacaaagatttctactgaaacaacaaatacttctgagcagagagattcagaactctacacatttgaatgtccagtttatcaaacacctgagcggtcaagaattttgacaactggcttaccctcgaactttctaaca

SEQ ID NO: 10499 - DNA, 237 bp, Canis familiaris
taatcatccagaagaaactcaacatcgtcaggagagcctttaagggcacggaccgcacacacgtgggagttcacatttttggcttattcatcgagggagccaggtggaatcatgaacaaaatgcactagaagactcgctgcctcgtgagctatgctgcgattttcctgaaatctatttcttgccaacaaagatttctactgaaacaacaaatacttctgagcagagagattcagaac

SEQ ID NO: 10500 - DNA, 391 bp, Canis familiaris
  misc_feature (26)..(26): n is a, c, g, or t
tcagcgccgctggaacgagatgaaangcccgcggcgcacctggggcgcttccggacgcccggcaagtggtgacgtcatcgtttttgcctccgccgcaccccccgcaactgaatccgagaaatatttcatagattctgagcaagcgtggaaccatccatcggctgttcttccaggcagtatcttacagcacatgaagtaaagaagaaataactaagtcggaggaaacatcaacagccccagatcaggacagatgagaagcagacggcagcatgtctgacatgaaggaataaaactcggagattcctgaattctagcctctcaatttccctaaactccaagcttgatcctcctgggaaaatcctctcgatttatctcttctgggcctcacttt

SEQ ID NO: 10501 - DNA, 329 bp, Canis familiaris
tgtgggcagctctacagtcctcaattcctgactggctctgctctgcacttgatgaacagctttctctgggggtctcagcagccccagagacctgactttggaatctggctatgggtggatgtgtggcctcaaatgaagacagggctccttccttctcagccttccccaggctctttcccagttctggcctgagccagggcatgatgaagagctcagccttccctgtatctctgtgccaagcctcaggggccagataaaagtgcttcctcttggaatctcagttttcttatccataaaatagagctacctacctcccaagggtgtgtgag

SEQ ID NO: 10502 - DNA, 343 bp, Canis familiaris
  misc_feature (149)..(149): n is a, c, g, or t
  misc_feature (247)..(247): n is a, c, g, or t
agacctctacccattggcacggtcttctctgtgaccatcgactcttcctggatattccatatcgggccttggatcaaggcaaccgggaaagtttgactgcaacactggagtatgtggaggagaagaccaacgtggactccgtgtttgtnaacttccaaaacaaccggaatgacagaggtgccctgctacgggctttcagctacatggggtttgagttggtcagaccagatcaccctgccctccctcnctgggacaatgtcatctttatggtgtatccccttgaaagggaccttggccacctgcccagtgagcctccttgaacatgcttattcctactgagagg

SEQ ID NO: 10503 - DNA, 130 bp, Canis familiaris
ctgcttggcttgctgatgccttttagggcttttggagacgtaaagttcaaatggagcattgaccttcaaaagagagtgatagaatcgggcccagaccagttgaacgacaacgaatacaccaagttcatcc

SEQ ID NO: 10504 - DNA, 460 bp, Canis familiaris
  misc_feature (58)..(58): n is a, c, g, or t
  misc_feature (183)..(183): n is a, c, g, or t
gtttggtgtcgcaaggccctgagaaagagcaggactctggggagccagagtgctcccnccgcagtcccagtcttgggaggaagtttgtcctagtagggcagtgagcagggcaagggtggggtgaaggccttggaggacaagttgcccttcttctctcacttctcatggtcaggctggccctcngtgactagagcaccacttgccagtggtgcagatgggcagataagctggtcctagagagattcttggcttggactgcagcatctgttgagtgtgttggaccatagcattggcctctatttcctaggatgctggccgaaaggacaaaggagcaaagggtgggaaggtggaattcaaacccactattccccaattcccacagacatcaccaggccctcagcatttctcaacaggggtatagctactgccttccttggttgttttctgactccaatctact

SEQ ID NO: 10505 - DNA, 309 bp, Canis familiaris
  misc_feature (276)..(276): n is a, c, g, or t
cggcactcagagcatgtatcattcagcgctggtggaagcagatcctgatgaagctggtggagaagaggaagcgactggccctagatttctatgtgcaccaagaatgggcagtggtcaagctgcaatcctgggtccgtatgtggcccatacgtgttcgttactgccgtttgctccactctgtccgcatcatccaaatctattggcgctggcacaactgccgtacccgtggttttattcagggcgattacatcctcaaagaaagtcaactgaatcttnaacttgaaatctctttaggcacacaggcttgta

SEQ ID NO: 10506 - DNA, 510 bp, Canis familiaris
aacgggatgagttctgggacacagcacctgcctttgagggccgcaaggagatctgggacgccctcaaggccgccgcctatgcagctgaggccaacgaccacgagctggctcaggccatcctggacggagccagcatcaccctgcctcatggcaccctctgtgaatgctacgacgagctgggcaatcgctaccagctgcccatctactgcctgtcgccgcccgtgaacctgctgctggagcacactgaggaggagagcctggagccgccagagcccacgcccagcgtgcgccgcgagttccccctgaaggtgcgcctttccacgggcaaggacgtgaggctcagcgccagcctgcctgacacagtggggcagctgaagaggcagctgcacacccaagagggcattgagccgtcctggcaacggtggttcttctccgggaagctgctcacagaccgcacgcgactccaggaaaccaagatccagaaagattttgttatccaggtcatcatca

SEQ ID NO: 10507 - DNA, 422 bp, Canis familiaris
  misc_feature (33)..(33): n is a, c, g, or t
  misc_feature (35)..(35): n is a, c, g, or t
  misc_feature (42)..(42): n is a, c, g, or t
  misc_feature (116)..(116): n is a, c, g, or t
  misc_feature (262)..(262): n is a, c, g, or t
gaatccatgttctctatagctgggaaggtggcnanccccagnaaaagaaaatgtacaaaagatcctggctcctgccaaaagtccggtggggcaaaccaacactcagaagacaaganggaactccaaggcccaatcttcccccaccgagaagcaggtgtgcctgggcttcttggatggaccccattccccagacagtaagctccggcaccgctcccattctcaccaactccattctgcctcagtcctggaccaccctcgccanctgccctaggcactgtcctcgaatggcttgtgtcacccaatcagggaatgcaccctagatctcacctctcaccttagagggaaacgttggtctgctcaagaagactcaatacaatcaaaagactttgtaggctccccaacatctgtgtcccttgaagagg

SEQ ID NO: 10508 - DNA, 341 bp, Canis familiaris
  misc_feature (27)..(27): n is a, c, g, or t
  misc_feature (30)..(30): n is a, c, g, or t
  misc_feature (56)..(56): n is a, c, g, or t
  misc_feature (223)..(223): n is a, c, g, or t
  misc_feature (227)..(227): n is a, c, g, or t
agccatgggccgtttggactgtataanccncctgctcgattacggagcctccatanatgaaaaggatgcccggggggagacccccatgtccatcgcccggcgcatgaaccgcaagcacagtgagcgacgcatgttcctcttctactggatgtcaaggctggggacaaaggacccaaagaacttgatcaagaacaaggtttttctcagagcaaagtctgggttnggcnccaagaagagcccagtctaactcccactgggaacgtcggcccctcaaagcggactcgggaaacttttcggagttcaaattcacgcacggtggcccttggtgagcaggaagccca

SEQ ID NO: 10509 - DNA, 241 bp, Canis familiaris
  misc_feature (216)..(216): n is a, c, g, or t
gaaatcacatgacgatgagtatcctgaggaaaatctatgtgaaagacatcaacctatgtcccctacacaaactcaagaaaacaggatgtggcaatcacatggaacaggaaactgatgctgtctgcttgggggacccaggaaacccaatgatgtgccagctacagcaactgaatctgtgggtgctgagaggaatcttgtcccatggtggtgaggaantgccctggcgtatttctgtacatca

SEQ ID NO: 10510 - DNA, 421 bp, Canis familiaris
  misc_feature (61)..(61): n is a, c, g, or t
gtcacgcagctcctggaagtggcaaagtcaggatccaaagcctggtttgccggactctttncactgcaccaccagctgaagggtttcggtgacctctttctggggacatgggcctttcccagacgctgggtttggagatgacaccggccttttccaacacatccatccgcttttccagccagctccatctctgggttggctggcggctccgggaagcagccaaaggcccgcatccatccgagtggctgggctctgctgtgattacagcccattctcagtcatcccgcatgcagttatccgcactggggactatccaagtgaccagctactgagacctgccaggccccgagctggcaaagaatttaccaggctttttccgtgctgagcctcctactctgtcaactggtctccactgaaacat

SEQ ID NO: 10511 - DNA, 507 bp, Canis familiaris
aaccttaattcatctatacccatcgaagtcccaatgctaaaaagtaaaattacctggtggacagataagtatgtcaagtttcagaatccaagttccattaatctttctagtgcatttgcagggaccacaaagcccccatactggtctaagcctgtctatgaactagatgaagaggatccaggaaataatggcttcctcaatgatgacttcatcgtgtggatgcggacagccgcctttcccactttcaaaaaactgtaccgtcgactcaatcgaatacagtactttattgaaggcttgcctgctggtaactatagtttcaacattacctacagtcttctcatctttgattttccagtaaccaggttcaaaggagaaaaatcagttgttctttccaccttgacatggagcggaggcagcagcctttttttaggtctcgcctacacagtgacaggagcagtaacatggttggccgccttttccatgatggccattcacctgatgctgaaa

SEQ ID NO: 10512 - DNA, 501 bp, Canis familiaris
gagaagttgggtgtccatcccacaagctgccatggttggattattggagaacatgatatatttcttttagtgcctttatggagtggagtgaatgttgctggtgttgctctgaagactctagaccctaaattaggaactgatgcagacaaagaccagtggaaaaatatccacaaacaagttgttgaaagtgcctatgagattatcaagctgaaagggtatacctcttgggctattggactgtctgtgacagatctggtaggatcagttttgaaaaatcttaggagagtgcatccagtttctactatggttaagggcttatatggaataaaagaagaaatctttctcagtatcccctgtgttttggggcaaaatggtgtctcagatattgtgaaagttaacttgaattctgacgaggaggccctttttaagaagagtgcagacacactctggaatgtccaaaaagagctggtgttttaaagcctcttaatgttccactgtttt

SEQ ID NO: 10513 - DNA, 423 bp, Canis familiaris
  misc_feature (85)..(85): n is a, c, g, or t
  misc_feature (104)..(104): n is a, c, g, or t
  misc_feature (329)..(329): n is a, c, g, or t
  misc_feature (332)..(332): n is a, c, g, or t
gaagccgatatctatatggcaacctctatacatctgatggtaaaaatgtagctccacaggccatcagtggagagaatttgaaccncgtgggatgattagaggtnccaggtagatgtcctcttagaaaaaaaaaggttatgggaatggaaggtgaagttcttactgctgctctatcaaaaaagcaatcaggatgtacctcgatcagctgtaatgtgtcaacattcctgagaagaaccaggaaaggaaaatttgggtatctcaaaatcacacacacattaactgctccctctgcatggtcagaaataaaagcattcaggagcacctgggtngcncagggtgttaatcgtctgtcttctgctcaggtcctgatcccagggggtccagagatcgagccccacatcatgttgcctgctcagctaggag

SEQ ID NO: 10514 - DNA, 82 bp, Canis familiaris
atacataatttagcattctcatacatcttggctaaatagtaccatactgtctaatctcaaaggcataaaaaactggccacaa

SEQ ID NO: 10515 - DNA, 310 bp, Canis familiaris
gaggccgagaaacatcttcactcctccaactcctcttctaaaacccaaccccaacagctcctgtatatctagcgtggtaagaaaaacaccaggccctggtgaactctactaatttctcggtgtactttactgtggcagaccgtgtggcgaatgtcaaagttggttcgaagacctactgacgacgttgactccctatggcatctgtggagctttgtgtacaagactgaaaggagagctgacagccaagattagcgaaccatcttgctcacgggggcttcaggaatatggactcttaaaactcggctatgac

SEQ ID NO: 10516 - DNA, 556 bp, Canis familiaris
ggagacgctggtgttcatcgagacagggaccagaaggggagttgtgggttttaagggctgcagtccagcctcatcttaccccccgcaagtctcctaccttgtttcgccacctggattgtccattgcctcctatagccgtgtctgccgcacatatctctgcaataacctcaccaacttggatccatttgtgaaactcaaggccggcactcctaagtcgacagcattttcttcccacagttgccccacctgcgtgggtgaacactctaagtcttgcctcccaaattttgtcaccactgatttttgcccctacgacgcctctaagtgttacagttccaccttaaaattccaggcagggcttctcaataccaccttcctcctcttgggctgtgctcgtggacatcacaaacttttatcagattttcaccatattggaaacatcagagtaactgaggtcctcaacatcttagagaaggcccaggttgctagtgcagagcgctccagccatagtcctgcttggagcatcctctccagttttctgcttgccttcagggactaa

SEQ ID NO: 10517 - DNA, 338 bp, Canis familiaris
agatcagcatcagccaatcatcattccagatactcccagccctcctgtgagtgtcatcaccatccgcagtgacactgatgaggaagaggacaacaagtataagcctagcagctctggcctgaaggcaaggtcaaatgtcatcagttatgtcactgtcaatgactctccagattctgactcttccttgagcagcccatattccactgataccctgagtgctctccggggcaatagtggatcccttgtggaggggcccggcagagttgtgggggatggcgctagcacccgcaccatcattgtgcctccactgaaaactcagcttggtgactgcacagtag

SEQ ID NO: 10518 - DNA, 480 bp, Canis familiaris
  misc_feature (128)..(128): n is a, c, g, or t
gtgagagctgcactccaatcaaagctcttggctagccatggctgcaaagtgtgccacagcttaacccccttctgtgatgagctcgaaggactccaagaagtgctcccagtgtaagaagaagagtaganccaaggtccaggaaaaatttgccaggaagtttccgtacaggttctcttggctgacggagcacaacgtggagttcctgaagccctgggaggtcacgaagatgaccacctcactgcgggatcaactgcccctgcagaagatgttggtggcaacgagatccattccagtcagagggcttggggccccagactgtatatcaccgtctagcttcagccccctgccgccgccgtctccactgagcaaactttgggaactcaagatactgagcctccgcttccccctcggccacctgcccctggcgctccgggcagtggccacagagcacggccttccggacggacgtgaactctattg

SEQ ID NO: 10519 - DNA, 140 bp, Canis familiaris
atgatcgtgcttggctggatgctttttgttggacttgcatgttacatgggcacatttccggagttcatgcctccaactctgaagtggaaggaaaagtggcctgttcaggagaacaagacacgactgaggagctgggcttt

SEQ ID NO: 10520 - DNA, 268 bp, Canis familiaris
  misc_feature (157)..(157): n is a, c, g, or t
gagactatcgacaaagcagtggtgccagcagttccagcttcagcagtagccgtgcaggcagcagccgcagtggtggaggtggccacggcagcagcagagggtttggtggagaacttggagcctcacacccagggggacaggagctgatctgtgaccncaaagacaaaaaccaaatgctgaccatagtggaatagaacgatgagcaaacctacatcatggatgacccagtgaaaccagtaccccagccttggctgtcttccccagtgtg

SEQ ID NO: 10521 - DNA, 300 bp, Canis familiaris
atggttctcaccatgctgggggctctgtaccccagggccgggctgagcctcttcctcctctacctcatcctggcagctgcactcctccacccccagccactgaggcctcagcaatctgttcctgaagaattctcagcccctctggaactctcgcagccactttccggcctggtggatgactatggggttcgacccaagcacccctggccacgaggccctcgccccctcctctcccgggcccagcagcgcaagcgggacgggccagacatggctgagtattactacgacgcacacctgtga

SEQ ID NO: 10522 - DNA, 452 bp, Canis familiaris
  misc_feature (29)..(29): n is a, c, g, or t
  misc_feature (65)..(65): n is a, c, g, or t
  misc_feature (90)..(90): n is a, c, g, or t
  misc_feature (102)..(102): n is a, c, g, or t
  misc_feature (186)..(186): n is a, c, g, or t
  misc_feature (208)..(208): n is a, c, g, or t
  misc_feature (218)..(218): n is a, c, g, or t
  misc_feature (337)..(337): n is a, c, g, or t
  misc_feature (349)..(349): n is a, c, g, or t
tatagactggtaagggccgtgtctggttnagaccccaatgcaaatgggtgaaggaaaaaccctcnctggtgtcgatgagcctccaaaacnccctgccaaccncgtggaaggattcggaagcagaactctggggctgagacctagacctccctgctcagctgtgtacctctgcacataattggaggnccttaccccaggtacctaagcnctggacaagnccatgccagggaaactgccatatggttactggatatgagagcagcaatcagaagacctgggacagtagacaaggacaattgtttgccaccaactatctcgctctccaatgggactcccnttccccccaccncattgaaaccgaaacccctctggtgccaagaatgagcatgattttttttttttaagctttgctttgtttctacggaatgatctcatgctgatttgcttataaa

SEQ ID NO: 10523 - DNA, 429 bp, Canis familiaris
caagggctgccgacttcttgttcagctgtgatgcctcccacccagacacgctgagaatatatcagagccttgattacatagaagacaatgctacagtttttcacgcccactatctctctgcagtcgctaatgctgaaataaaaaactcggtgactttaggtcatttcattcttccccctgagtgcttgcaaaaagaaataagaagaaaacttggtaattttatttgggaacaagaccaacattttcagatagaaaagcattatgaagtaacaccaaatgaaataaaagcccttagggaaaacagtgaactagaaacagatcgcaaaaaagaattatccaaaaggttatatatcaattgatgccatgaagaaattccttggggagctacatgactttattcctggaagctcaggatatttggcataccat

SEQ ID NO: 10524 - DNA, 277 bp, Canis familiaris
  misc_feature (149)..(149): n is a, c, g, or t
  misc_feature (231)..(231): n is a, c, g, or t
agaatgagcaaactccatgagcagcagggcacgagctgaggttcttcaccagaggtcgacgtggggagccactcggacctacggatccggaggaacttggcggaggctaacacgcggcaaaagatccttcttctttcttccttgataangagtaaaaggaactgcttgacttcaaaaaatgagattagcaacgtccctcttactgtggggctggacggtaaaggcttttcngttccaaaagccaagacccttccgctatgtgacactcctccaaggt

SEQ ID NO: 10525 - DNA, 581 bp, Canis familiaris
taagcatgcttttgtcaccatctgctaaaatgcagtatgttggaggtgaagcagtcatagccctaagtaaggatagcaggatgcatcaaaatcaaatatgtgaagggaacggaattgcaccgttgattcgcttactgaggattagtaaaatagccgaaggcacacttctgagtgtcatcagagcagtggggtccatctgtattggatatttgtttaagggcaggctacgcattaaccctttttgccttcaataatcgccttcaacaatacttgatattggaaagtggagtaatgaccatatcaatttttgaaccttttcttgaatcaacaattgaaacagagaaggcaatggcagcatttcaggttatcatcttagctaaagtcattatagatgtggaccatattacgttgtctgcgagaggtgttactattttagttgctagtctgtattcagttcattccactactgtttaatttatagggaatttgatagccagcctggctcattccagagctggtattccagaagcatttaccacattagggacaatccaacggctttgctatcatttgtactcagg

SEQ ID NO: 10526 - DNA, 492 bp, Canis familiaris
aatcctatcagtcaacaattcgttgtacaagaaaatgccttcccagtacttcttcaactactgagaaatcacccttctcctaacatcagggttgaagtggcattttccttggcatgcattgtcctaaggaatgatctgttacagaatgaattacaagaaaacgaaggatttaaatatgctgatgtcctctatcttcttcactcacaagataaggatatttgtttaagggcaggctacgcattaaccctttttgccttcaataatcgccttcaacaatacttgatattggaaagtggagtaatgaccatatcaatttttgaaccttttcttgaatcaacaattgaaacagagaaggcaatggcagcatttcagattatcatcttagctaaagtcattatagatgtggaccatattacgttgtctgcgagaggtgttactattttagttgctagtctgtattcagttcattccactactattgtcctgacaggg

SEQ ID NO: 10527 - DNA, 425 bp, Canis familiaris
  misc_feature (32)..(32): n is a, c, g, or t
  misc_feature (60)..(60): n is a, c, g, or t
  misc_feature (85)..(85): n is a, c, g, or t
  misc_feature (104)..(104): n is a, c, g, or t
  misc_feature (108)..(108): n is a, c, g, or t
  misc_feature (198)..(198): n is a, c, g, or t
  misc_feature (220)..(220): n is a, c, g, or t
  misc_feature (227)..(227): n is a, c, g, or t
  misc_feature (389)..(389): n is a, c, g, or t
gcctcagagttttgagttccccgatcagatgnagatgatggagcccatgtagatttcaancagattccccatgatttcagctatnaaataaggagtgtctgcgnaggnaggatgccacatggaacatattcttcgtgaggctgatgatttctttcgtctggaatacggcccccgtagaagtaaaggagaaagacatgnccttttagaggtgcttgcgggnaaacagngaggagagcacgtagaatgagcaaactccatgagcagcagggcacgagctgaggttcttcaccagaggtcgacgtggggagccactcggacctacggatccggaggaacttggcggaggctaacacgcggcaaaagatccttcttctttcttccttgataangagtaaaaggaactgcttgacttcaaaaaatgagat

SEQ ID NO: 10528 - DNA, 552 bp, Canis familiaris
tgtgctcctgcagctactgaacgacctttctcctccaaagctatccccaaaatgagacagcccaaactttcggactctctgagtcttcagacaacttgtgtcaataaaagtcgtgaaaaaagaaaaagcacttgtggatcttgcaagcttgaacaaaatgcttcaaaatggaatgggagcaatgccggcaaatgcaaatggacttccaaaccaccatctctcaaaagttcatccaccaccaaacaattggttgcaacttgtgatgacattaggaacctcaaaagctccattttaaatccatgccaagaactctcaaccaaggccactacttcccagacagcccaatcattggttaaaatggtctcaaccagatgtctgccaccaaggtctccgatcccagtttcagctatacctctgtcttttcccgaaaatcagagagaagaaattaaggcaccaaggaccaaaaagaaaacttatcaaaaaaacattgaattaaacaaatcactctatattcagaagttaaactgtttatcaccttcctttacagctaag

SEQ ID NO: 10529 - DNA, 247 bp, Canis familiaris
atttcccaccacatttgagagcgagaagcaacatgcaagtgaagaaagcttcatgtccgaagagagattcctacccaggatgccttccccagataccgtcagaaaggaagcgaaggaaccaccagcgcctaaaattgtgattttcgaatttgcacaccgcctatcccaggagatcttgagtgacgccttgaagcagtgggcaggcgagaacatcaagtactatgacatcccatacattgagagtgaa

SEQ ID NO: 10530 - DNA, 481 bp, Canis familiaris
  misc_feature (34)..(34): n is a, c, g, or t
  misc_feature (69)..(69): n is a, c, g, or t
  misc_feature (112)..(112): n is a, c, g, or t
aatccagatctcttttctcgaggttgggaggagnccgccctccgcactgagccgcaagtggggaaagcnccgggagcggagagcctcttctcttgtgtcagttgtccaacgncccggcacaatttaggtcaacatttcgatgatattcaaataatctattcgcctgcctgtggaattatcaccaggtgcctcactcctagcctcggacaggatgcatctggtcttggagtggaagggaagggaattcacgtggattgtgtccccagcctgggccacaggctaggtagactgctttaaatgcgttatctcattcatgtgtcaccacagccatgtgagctaggtgttataatccccttgatccctcagcaaatcgaggttagaaaaatttgctgaaatttcacggtttggacatgaaggacacaggtctgtccgcatccaaagcacatacttgttttcactggaccagagttcatgcctttga

SEQ ID NO: 10531 - DNA, 404 bp, Canis familiaris
  misc_feature (282)..(282): n is a, c, g, or t
  misc_feature (328)..(328): n is a, c, g, or t
ggaagccgatgaggcttgcatctgagggcgtgccgtcccatgccagcctctcggctcatctgaccacggtctgcccatctgccacatggggcaagtcaatctgctctgcccacctcacgtgaggtgggggtcacaggagacatcatatgtgacagatatgccatctgagagccacaaagggacctggtggctgggggctctgagatgtggccagggtcctagatctggatgggccatggaaggtgaccggaggaagggcagatggaacatgctggaaaggancctttggagaagacgtcattctgatgaggattactaataacacctncagggccatggcagcagggagcacatcccagcacaccccacaccccagaccaagtacagctttcccagcaccatgg

SEQ ID NO: 10532 - DNA, 509 bp, Canis familiaris
  misc_feature (63)..(63): n is a, c, g, or t
  misc_feature (103)..(103): n is a, c, g, or t
  misc_feature (411)..(411): n is a, c, g, or t
aaatggagccacctgatatttactcatctgggcagtggtgtgagattcatattatcaaatatngcagcagctcagttttagcgtgtgaatatttcagaagggncccgaaagggagatggatgccatacaggccaaggaggaagtgaagaaggcccgtgaggaagatgagcaggacttgctgatgggcaggtttggtgggcaagaaaacattttccagagatttcataagagggatgaactttagtcattcccacctcagataaagatgactggtaaaaccttgcctttactttaatcgacatgtaaaagtgcaaatgtcaacatacgtggtaatttgtccagttttctttgaaaacgttcctatgcttctcagtggggttggcctggtgttccgtcagcctcagccctgcngtaccaacatgttgtctctcgacaaacctgaatgctaggagtcagaggccggtaagggtctggccaaagatacgatgctctttcctgagcccctaaaa

SEQ ID NO: 10533 - DNA, 433 bp, Canis familiaris
agccattggactaggagcctccatattgcctctttgtgatgtggtttgggccaatgaaaaggcttggtttcagacaccctatactaccttcggacagagtccagatggctgttccaccgttatgtttcccaagattatgggaggagcatctgcaaatgaaatgttgctcagtggacggaagctgacggcgcaggaggcatgcggcaaaggcctggtgtcccaggtgttctggccagggaccttcacccaggaggtcatggttcgcatcaaggagctcgcctcctgtaatccagttgtgctggaagaatccaaagcccttgtgcgctgtaacatgaagatggagctggagcaggccaacgagagggagtgtgaagtgctgaagaagatctggggctcggcccaggggatggactccatgctgaagtacctgcag

SEQ ID NO: 10534 - DNA, 380 bp, Canis familiaris
  misc_feature (63)..(64): n is a, c, g, or t
  misc_feature (192)..(192): n is a, c, g, or t
  misc_feature (230)..(230): n is a, c, g, or t
ccaatctcagttgaggccagggcatccagggtgaagaataaatgcgatcaagcctgtagctgnnccccctgctgctgttctctctccctccaacctgtcccttcccaggggagggggtgggttctgggcacagcaggagtcaaggggccaggggctactggggttttggaagagtaatttgttcctcagganggagtccatgggaacagaagggagggcagaggcggggnacagcctgtttctctgtaacattctaggctcagggcagagcacatctggatggggtgggaaggaggctccccatcttttgggagactggtctgtgaaatccactcggggataggcagtgctgtctgcagtgatacccctaataaattgaa

SEQ ID NO: 10535 - DNA, 366 bp, Canis familiaris
  misc_feature (73)..(73): n is a, c, g, or t
  misc_feature (75)..(75): n is a, c, g, or t
tacaggctgagaccttttagctcctcactgactttgcatctacagcagaagccaactcctccactaataactncncccttcggtgcttctctgtcctctcctgtggccactcttgaagcgaggtcattactaaccatagttacttactggcacaatggttctctgcaatgtgaaaagacctgaaaagttaatactgcccgaaatcatggctcttcacatgggcatcaacagctgatgagtggccgaaggcagagtgagcacagacgtctcaagactgaaacagcacctcaccctctgcaggagtggacttcattcagccacagacaagtaaccactaacctgttttgttctgtttgcatctgtgga

SEQ ID NO: 10536 - DNA, 462 bp, Canis familiaris
  misc_feature (51)..(51): n is a, c, g, or t
  misc_feature (72)..(72): n is a, c, g, or t
  misc_feature (74)..(75): n is a, c, g, or t
  misc_feature (78)..(78): n is a, c, g, or t
  misc_feature (111)..(111): n is a, c, g, or t
  misc_feature (164)..(164): n is a, c, g, or t
  misc_feature (214)..(214): n is a, c, g, or t
  misc_feature (414)..(414): n is a, c, g, or t
atcagaggcatcaactaccttgacagatccaccaatgccttctgtaccaanggtcccaagtcatcactgagncnnccnaaggcttgcagccaactacctggaacgcgtggncaactccatccacctggaccacccagaccactccttcccccgcagtaactccnagtcccatcaccagcacggctgcctctgacaactacaccaacacctgcanggtgccttcccccaggggtgtcaacacgctgcagtatacggatgagcctgccggcaccagttacccgcaccggcttcagagccggagcctcacacctgtgctgccgcagaggcccgggatgaagctgcccgagctccccttgttcggcaacgggatcttttccttaggtcgccttcccaagctctgggaagcaatccgcncgggcttgagagcccccgagcccatctctaaaccctgtagctggtggt

SEQ ID NO: 10537 - DNA, 49 bp, Canis familiaris
gctggtggtaacatcgaccatgaaatgggtacatgtccatcaagctgca

SEQ ID NO: 10538 - DNA, 249 bp, Canis familiaris
  misc_feature (32)..(32): n is a, c, g, or t
  misc_feature (160)..(160): n is a, c, g, or t
  misc_feature (207)..(207): n is a, c, g, or t
cagcgctacgtaaccatcatgaaccggctacnaaagcctgggctacaacgggcgggtgcacccggcgctgaccgagcagctggtgaacgcctatggcatcctgcgcgagaggccggagctggctgcatccgagggcagctcctacagcatggacttcctncagcgcgtgctggtggagaccgtgcatcccagtgtgctcactgatgngctgctgttgctctcctgcctcagccagttggcacgtgacga

SEQ ID NO: 10539 - DNA, 541 bp, Canis familiaris
cactgcttcttaccatttcttgagataaacattgctacttcaaaacacagtttccaaaacaagattgaaaacctaaggcccaggcttactgtccaacacccagattttacccgggattctgctgagcatgacctcatgctcatcaagctgagtcatccccaaaagctcaacgatcaggtgaagctggtggccctgcccaacaccacagatgacagaagagggggaaagtgcactgtctctggctggggctgggaatggaaggattccagctcagagcctgacgtccagataaaccagaccgtcttttggttctctaatgatgactgcaaggagtcccctgtaagacaaattcctgttcaaatcacggagaacatgttctgtgcaggatcatctctggagaacaaacacatgtgtaaggaattggcagctgccccagtcttgtgccaaaatcagctccaaggcatcctatcttggtcagcagggtgcattctgagaggcgatgtcggctactacaccaaggtttcccgctatacagactgga

SEQ ID NO: 10540 - DNA, 103 bp, Canis familiaris
gaacttgtttgggatgtggaagcctatggtgttcttggctattgcggctgtggctctgtatgtgttacccaacatgcgaccgcaggagtcagagttctgcctc

SEQ ID NO: 10541 - DNA, 514 bp, Canis familiaris
atattccagacagagatgctgcctgggaactcgagccaggggctttctcggagttgtatcagcgctatcaacactgtgatgcccccatctgtctgtatgaacaaggcagagacagctttgaggaagaagggaggtggcgcctcattctgtgtgctacatgtggatcccatggaacccatagggactgctcctctcttagatccaacagtaagaaatgggagtgtgaggagtgtgcaccttctgctgaagccacagactatacaccagaaaactcaggtgacatcccttgttgcagcagcaccttccactctgggaggcatttctgcagagacaccagcctggaagagaatccaggcccttcttggactaattggccaggaccttccttattagaaaagccagagtcctctggtggcaggaggagccactcctggcggtccaagggtgtcaaaatcactaagagctgcaaaaaatccaagtaacagcttccgagtagtcgctgccaagtacattt

SEQ ID NO: 10542 - DNA, 332 bp, Canis familiaris
gtgaagacttatcccaagcaagtgttgaaaacatccagagtccatgttgtagtcaaactatctaccaccgcaagtgcatacagaaatatgctcacacatcagcaaaacatttcttcaaatgtccacagtgtaacaatcgagaagagtttcctcaagaaatgctaagaatgggaattcatattccagacaggaggtggcgcctcattctgtgtgctacatgtggatcccatggaacccatagggactgctcctctcttagatccaacagtaagaaatgggagtgtgaggagtgtgcaccttctgctgaagccacagactatacaccagaaaac

SEQ ID NO: 10543 - DNA, 368 bp, Canis familiaris
  misc_feature (30)..(30): n is a, c, g, or t
  misc_feature (172)..(172): n is a, c, g, or t
  misc_feature (253)..(253): n is a, c, g, or t
  misc_feature (273)..(273): n is a, c, g, or t
tggtgctgagtaagcgctccctcaccgggnccgcgggctgcacgtccccagctacacccgcttcaacctggacaagtgaccgcttggcccagatcactggtttctaccagatggcacaggagcatcggaagtactatctagacaagacaggcctggtgcctcgggtcccctncttcgtgttgcctgtgaaggagtgggaacggtaccccctccccactgaccttcctcctctgagcccagagaagaagtgganccttttaagagtatcccctnagaatctgaagacctaccagacattcccctcggggaagagggtgtccccacaggagcggcagaagagagaccgatactttgaattcagagcgtga

SEQ ID NO: 10544 - DNA, 35 bp, Canis familiaris
gaattcagagcgtgatgcctgagagcctggctctg

SEQ ID NO: 10545 - DNA, 163 bp, Canis familiaris
taatctcagtgggttaccatgtgaataagccgaatgcagtcttcaagctgaagcaaggaaaacaaccgtggatactggaagtagaatttccacattggaattccccagaagacctatggaaaattcatgacctaggagcaagataccaggaaagccgaaccga

SEQ ID NO: 10546 - DNA, 472 bp, Canis familiaris
tgatgggtacttcatgcacgctccaacttggtgtattgtgcatgctagtagtagtcaaggatgggtgccttggaagtatcggatgttcctaagagatgagttatgcatcaaacgggaagagagcctcttctttgagttttgcgatgtggtgaagaaggcctatggcaagtgtgccattgtggtcaaagagagaaggcagcaggacaagatgaagccaaaagaagacacagagctggaggcccaggtccgcgtcccatcagtcattagcttaatgagcattgtgtgttgccctgaggtagccaagtcctgtggccatgaactactctctttgccttccccttacaattacctaaaccctctagactcagcctggtcttctctgaaatggtttatcatcaataacagaaaggagttttgcttgcagtacattgacaatgtctattcttaccagtatatacttctcagcgattta

SEQ ID NO: 10547 - DNA, 313 bp, Canis familiaris
  misc_feature (73)..(73): n is a, c, g, or t
  misc_feature (79)..(79): n is a, c, g, or t
  misc_feature (199)..(199): n is a, c, g, or t
aagatggtgccttctaaccagagaatgcatagtagcccttcttaccgccaaatgaactgctttacgcacctcnagccangacctactgtggcagctttgcttacgcatgcccggagatcttgctgggcttgccctacaaccctttcctgtctgacacctggagcatgggcgtcatcctctacactctagtggtcgcccnggctgccctttgatgacaccaatctcaagaagctgctgaaagagactcaaaaggaggtcacttttccatctaactactccatctctcaggagtgcaagaacctggtccttcaga

SEQ ID NO: 10548 - DNA, 37 bp, Canis familiaris
caaagaaaccacaactgcaaagaccacagtgccttct

SEQ ID NO: 10549 - DNA, 472 bp, Canis familiaris
  misc_feature (289)..(299): n is a, c, g, or t
  misc_feature (383)..(383): n is a, c, g, or t
  misc_feature (395)..(395): n is a, c, g, or t
tgctctggcccgagcgctggcactgccacccccgctgccggcagggcccggccgtcctcacgcgccaccgccacgctgcccgcagtcttcgtgctcgagtactacctggacaccctgtggaagggcacgctgctcttcgtcgtctgcctcctcctcgtcagcttcggcgtggtgagccagcctacggaaggtgcttcttccagctggttctgtgcggccacaaactagagccgctggtgctggtgcagctgtcagagcgctacgagcagatggaatacctgggccgtcnnnnnnnnnnnaagctcaacattaactactttgactgcctggccacgtcctaccgccacgtggtccgccactggccgctgggggccgccttcagnccgggcatcgtncagcgcaagacccgcacgtacgacaagcgggactcccagtccgacctggacctggacctggacgtgtgacgccacag

SEQ ID NO: 10550 - DNA, 301 bp, Canis familiaris
gaagcaacagttttgacaagcagcaattatgataagagaccaaaagattttcctcagggaaaagaaaatcccatggtccagaggacttctacgatttcttcctctacacttggagtcttcatgtcccgtaaaatttctccacattaggtccatctcctctcggtatagctcaacagcctccatgatcctctcagcctacaatgatggcaacaaaggagagaagtcattgccacatgccccagcatcctggaaccctgcaattggaaggcctgactggaaaagcactacctagcttgaactg

SEQ ID NO: 10551 - DNA, 313 bp, Canis familiaris
ataaggcgtccaccaacagttgtttgctacatttgtggtcgtgaatatggaacaaaatctattgccatccatgaaccacaatgtctgaaaaagtggcataatgaaaacaacttgttacctaaagagttaaggagatcagaacctaaaaaaccagaagtcaggaccattactgctaaaggtttctatgatctcgatgccttaaatgaagctgcttggaccagtgccctgagccagttggttccctgtaatatttgtgggcgtaccttcctgccagacaggctgattgttcaccaacgatcctgtaaacccaaag

SEQ ID NO: 10552 - DNA, 138 bp, Canis familiaris
ggtacctgtgtctcctcgtgagagcctttcctttttggaattgaggcgacttcctgaacagccttgcacagatgcgtgaatctacccccctggctttgatggtcggaaggccagcagcatctcaagggctacagtcat

SEQ ID NO: 10553 - DNA, 49 bp, Canis familiaris
atctgactcaaagaaaattaattcatgactcagtttcccagagatagag

SEQ ID NO: 10554 - DNA, 463 bp, Canis familiaris
gaaatttgattctaaagcagctccttcacaaaatgtatctcaaaacttcacatcagctgaccatagcaaatccaaagataagagagactattcgtggacaccgactaaaagtactttatctacaccattgccaaaggcatatactgtgaagacaccaacgaaactaaaaattcagcaaagagaaagcaagaatgtacccactgaagaaagtaataaaaagagaaaaatggtctttgagtttgatattaattcggatagctcagaagctactgatcttttgagcatggtttcagaagaagagacattgaaaaaattatacaagaataataattatccaacaacttctcatctttgtgtcaggacaccaaaaaagaccccttcatctctaacaacccctggatctacgctgaagtttggagcgatgaggaaaatgcgggaagatcgttgggctgtaattgctaaa

SEQ ID NO: 10555 - DNA, 424 bp, Canis familiaris
  misc_feature (30)..(30): n is a, c, g, or t
  misc_feature (46)..(46): n is a, c, g, or t
  misc_feature (65)..(65): n is a, c, g, or t
  misc_feature (119)..(119): n is a, c, g, or t
  misc_feature (125)..(125): n is a, c, g, or t
  misc_feature (174)..(174): n is a, c, g, or t
  misc_feature (238)..(238): n is a, c, g, or t
  misc_feature (377)..(377): n is a, c, g, or t
tcctctattctggtgagcagtgttttattncaatgactgccgatcnctactaccatggctaagcncgatgggaacctcacgtgccacgtagccactgcagccaggcaggccgaagggtntggtancttagtccacactaagtccacgtgctacagtaaaagtagtgggttcccncttactgagtaatatctgtttataaggaaaagggtgctcaggagctagtttttttggttgccancggctctgatatactgtctgaagacaaatcatttcatccctttgtatatcattgatccccctttctggcaaaatgtagataatgatttcctctcggtttggtagattttaaactgctactatgaatcctcaaaaatacnttatctaaataacttagaccttaaatacatgtttttagtctctgaaa

SEQ ID NO: 10556 - DNA, 187 bp, Canis familiaris
gcctctggtggactaggcccactgagccagaaagctgagcaggtggcacctgttgcccaggcctggggcccagccctggcagtgccggaagccaggggctgccctgggggggctagctgggagatactacagtggactgagtatggccgatacaaccacaaattcccctatgcaaggcagccagaga

SEQ ID NO: 10557 - DNA, 359 bp, Canis familiaris
  misc_feature (26)..(26): n is a, c, g, or t
  misc_feature (28)..(29): n is a, c, g, or t
  misc_feature (84)..(84): n is a, c, g, or t
ggaatgtccagttagacgtgaccgangnnccaggctgatgatgaaggcgggacgctgatcgctcggaaggtgggagaggctgtncagagcactttgggagccgtggtgacagccattgacataccactagggctggtgaaggatgcggccaggccggcgtactgggtgcccgaccacgagatcctgcactgccacaactgccggaaggagttcagcatcaagctttccaagcaccactgccgggcctgcggacagggcttctgtgacgagtgctcccatgaccgtcgggccgtcccctcccgaggctgggaccatcctgtccgagtctgctttaactgcaataaaaagcccggtgacct

SEQ ID NO: 10558 - DNA, 502 bp, Canis familiaris
tagaaaaccagaatccttgctccaccatacattgtttagaagttccagaaggagagaggggtaaagagatcatagaacaacttcacaaactcatacaaccagaaactctgaagaacaccttggcttctacagactatggaatctcttcagcagaaccagaaaacgtgcccagttatcctgagctcactgatcatcttgaggagaaaacaatttcccccaaagttaaaactctgggaaaaaataaccatcaaaatgcattaagaagctttaagaaagcaaagtcaaatatttatatttacccagactttagtacatggatcaagctaacttttgtccatggaggaaagtggagatttttcctcagtgctacagagttagaagaattcatccaatggcttctttctaggccagccatctctcctgaggaaccacaacttgtaacccagagatattgtccattcactgggcttatttcaagtttaactacattctgtctctctgt

SEQ ID NO: 10559 - DNA, 241 bp, Canis familiaris
gaagatggtgcaggcttgtagatataagtgttcatcgtgccatctgaaggatttactacagagaaaaaaagcaaggaaattatgccagaaaaagaacaggaagacaagtcagcagcatacgccaatgctctggttgaagacactgcttgacgtcatgcttttccatgtcctgttttcttccacggccagcaaaaagaaaagcctattatgtggccggcccaagaccaccataatcatcttt

SEQ ID NO: 10560 - DNA, 317 bp, Canis familiaris
aagaagaggcttcccaggacataaaggagaagatgtccaccaactgccctcccactcacggccaggatgtccacgtcaccagagacgtggtgaagcaccatctctccaagtctgacttgttggcgaaccagagtcaagacgtcctggaggaaagaacaagaatccagttcatacgatggagccacacccgaatcttccaagtccccagtgaggtgagggacgatgtcatgcgagagcgaatagagcaggtgagacgcagcatatgcaacctcacggatgaagcgtcccaggagattcgcagcagaaattcctacgca

SEQ ID NO: 10561 - DNA, 467 bp, Canis familiaris
  misc_feature (26)..(26): n is a, c, g, or t
  misc_feature (36)..(36): n is a, c, g, or t
  misc_feature (85)..(85): n is a, c, g, or t
tgctactcagcttgcaggcagtttanttcttctggncactggcctgctcacttaaatacctgtgcagaggcttgggagtgagacnccggtggtgtgtttctaggacctacttcggacagtacttcggacttccttgagtccggtctagccctttacgggtcatctgagacccagccccctcatttgtgaacaggaacaatgataatactcgcctggcatggttgttatgcaaactaaatgtgccagtgtgagaccaccgtaacgactcagtaaaggctggctctggtggttagagaccaatatagtaacccgaacgtcaagctttggagtcatcaaaaccgggatccacagttggactacatttcccagcctcccttgcaactgggcattgtcacgtgacttcagttctagccaatggaatgtgagcaggagtgacgcacctattccaggcttgagaaccacggtga

SEQ ID NO: 10562 - DNA, 356 bp, Canis familiaris
  misc_feature (238)..(238): n is a, c, g, or t
agcaacatggactcctgcctttgttctgctggaaccatccctcctaccctgcatgagcaagagctctccttcacactcaaaaccacttggaaatcacccgatgacaggcctcccagaaggttccagttccccttcttgctgaaatgttcacgggccatttacttgtttccaggcacttgtccttatcgtacggtgttaacataaacagcggtgactgtgtccttcttccaagactgtnccagggcctggaacaagtgccacacccagagtggtatagagtaaatgaatggctctgatggttcatgacctttgccttaggagagcggaaggcaattccagtccaccagtcagggcag

SEQ ID NO: 10563 - DNA, 428 bp, Canis familiaris
  misc_feature (27)..(27): n is a, c, g, or t
  misc_feature (51)..(51): n is a, c, g, or t
  misc_feature (104)..(104): n is a, c, g, or t
  misc_feature (166)..(166): n is a, c, g, or t
  misc_feature (235)..(235): n is a, c, g, or t
  misc_feature (245)..(245): n is a, c, g, or t
  misc_feature (298)..(298): n is a, c, g, or t
  misc_feature (310)..(310): n is a, c, g, or t
aagtctgtactagaccatccgaagaancgcattttatttgtttcaagtccncacagtgaggagagctggctacccaggtggtgcccgttggaacaaagagaaanctgatctatgattaagacactgaagcatctgcacaggagtcaagacccttgccctgtgcatnccacgtgacgaatactgtgtgaaggaatggtaacgtgctttgagaacattcctgatgccctgtccacgnggacggtgcncacggcaaaacccctctctcaccgagggaggctttggcctcctcagcctggtncagtcaccaggncttgaacacatgtctcgggtgctgtaattccggacactgtgtcagcaaacctctctgcttgccagggaaaggcaccccctctcccttccaggagtcagaaatccatctttcaaggctc

SEQ ID NO: 10564 - DNA, 502 bp, Canis familiaris
  misc_feature (40)..(40): n is a, c, g, or t
  misc_feature (47)..(47): n is a, c, g, or t
gtgagttgagctgctgagacccacaatcactgacatacgngcacacngcacacacacaaactaatggtcttttctcagggaaagagtccatacacagtgaaggcaaggcccatgtctgagagcatccactgggcctcttccccccactccctaccccacacccactggatgtcccacacagtttgcagaacttcagaatgaatgattcctttcttcctacctgccttaggacctacttatttgacttcttacagccttaggcaaatgtttaaccactatgattaattggccagtaagacacatttaacgtaggtcataatatacaccgttttgttttcagaaggataggcttatttgttcaaggagttagaattttcaagcacagatgcttttcaactgtttgcatatctcaagtggaagtgagaaccaacacttcttgaacaccccttggccaggcactgtgccaggtgctgaatttcactcggttcattctctcaataaa

SEQ ID NO: 10565 - DNA, 161 bp, Canis familiaris
  misc_feature (40)..(40): n is a, c, g, or t
  misc_feature (81)..(81): n is a, c, g, or t
  misc_feature (132)..(132): n is a, c, g, or t
gggcaggtctctgtcactatcacacacaaggagggatganttgcaagaggaggattttcatgatggagagaaaagaagatnccctctttggaatccaagtacactcagctagtattttccatcattttggancctaattttcccatgagacttcctaaagg

SEQ ID NO: 10566 - DNA, 137 bp, Canis familiaris
gaaatgccagaagtagaaattgacattgatgatctacttgatgcagacagcgaagaagagagagctttaaaattacgggaagctcttgtagactgctacaaaccaacagaggaatttatccaggagctgctctctcg

SEQ ID NO: 10567 - DNA, 324 bp, Canis familiaris
  misc_feature (62)..(62): n is a, c, g, or t
  misc_feature (97)..(97): n is a, c, g, or t
cgtgcccgtcagtgagagcaacgtggccaaactgaccaacatctaccgggaccagagcttcnccacgtggctggtggccaccaacacctcaaccaangacatgatcattttacagacgctgcactggcgcatgcagctcagcatcgaggtgaaccccaaccgccccctgggccagcgtgccaggctgcgggagcccatcgcccaggaccagcccaaaatcctaagcaagaacgagccgataccacccagcgccctggtcaagcccaatgccaacgatgctcaggtcctcatgtggcggcccaagtacgggcagccactggtggt

SEQ ID NO: 10568 - DNA, 224 bp, Canis familiaris
gaaagtgaggctaccacactacttgttgagttccaagcccaagtctcaacctctcacgaaggtgcaggattctgttggaggaagagtgaaaacatcctctgttgcatctgctgccattaataatgtgaattcatccccttttggtttccacctgctcccaccatcggtgaagtttggcgtgcttaaagagggacacacctacgcaaccactgtaaagctcaaga

SEQ ID NO: 10569 - DNA, 515 bp, Canis familiaris
  misc_feature (490)..(490): n is a, c, g, or t
ggatcacaattggtcaacacctatgcaagagaatgaaatcagtaaagaaccttatgacgatcatcagtctgattctaataatagaaagcatcctgacccaaacagtaaggaacccttagaccctgacaacatagagctgtcagtgcagaagaccagcttgaagactcaggttcagtctgggccttcagaacagaccaggaacaatgagatcaaagatgaaggactcacaaaggctgatcctcttgaaaagaaacccaagaagatgactctggaagccgaattagaggacataaagaaaactcaacaacgcagtctaatggactggagtttcactgaacattttaaaccgaaagttctgcttcaggttctgcaagaagccagtcagcaatacaggtggattgattcttattaccatacccaggacaactctctacttttagtctttcataatccaatgaatacacaacgtctgcattgtgaacattggaanattgctcttcactccaacgttggat

SEQ ID NO: 10570 - DNA, 82 bp, Canis familiaris
ccgtggccacgcagaaaacagacacaggcctgactcaaggactcctgaaagtcctgcacaagcagtgtagccacaagcagta

SEQ ID NO: 10571 - DNA, 414 bp, Canis familiaris
atggtgccagtgctcatcggctgccccccaggcaagcgcctggcatttgacatcacctacacgctagagtacaaccgcctgcagaacaagcactactttgactgtgtgaatgttgaccccgagatgccctgcttcctcttccgtgacagtgcgtgtccagtgccctcacctcatttgttcactgtcctctgtccccaccactgggcccgccttccctcactgctcactcagttcctcactcaacctctgctcttccctttggtcttctcaactctccttcctcccctctccatcctcctaattctgaggctaatttcttctcctcctgactccctccaaccccacagtcttctaccctttcttcttgatccaagatctggtgacaggagattcgggcagttttcagggcaggta

SEQ ID NO: 10572 - DNA, 211 bp, Canis familiaris
  misc_feature (40)..(40): n is a, c, g, or t
  misc_feature (44)..(44): n is a, c, g, or t
agatcatctcagacatatccgtgccctgcaatgtaggccnagtnccgctgcctcatgttctgctttatcccttctcgcccagaggaggtgggtgagttctggctcaaaagacgagctacctttgaccccaaggcctggagggcccaatgtcgttgcaaacacagtcatgaagaccacgcagctacggggtcccatccctgcaggataaaag

SEQ ID NO: 10573 - DNA, 475 bp, Canis familiaris
  misc_feature (34)..(34): n is a, c, g, or t
  misc_feature (40)..(40): n is a, c, g, or t
  misc_feature (63)..(63): n is a, c, g, or t
  misc_feature (69)..(69): n is a, c, g, or t
  misc_feature (104)..(104): n is a, c, g, or t
  misc_feature (106)..(106): n is a, c, g, or t
  misc_feature (140)..(140): n is a, c, g, or t
  misc_feature (334)..(334): n is a, c, g, or t
  misc_feature (356)..(356): n is a, c, g, or t
  misc_feature (409)..(409): n is a, c, g, or t
ccggagtccagaagtgctgcatctagacagaggntgctancagcgctgagaaagctgtgcatnctgcanccacgtgggtgtgcgtggccccgtacttgtaggtncnccgcagataacaggtgctcctaaatctgaggaanccggagaagatagccttttagcagaaagaagagtggcagcttttctctgcctcccgggatccctggcgaatactgttcatgagtcacctgtggctcctgacagcagtgcccttcacagcttagtgactggattgctggattgccagggcgaccagaaacaaccggtggctacaagtcccagccagctagtgggnatcttctgccgcgtaccccttnctccgggtttccagcagagatggattacattccatgtgctgtggtgcattttngaggcaaaacaagtagattggaatcaatactggttccaaagggcagagactaaatgtaacacccac

SEQ ID NO: 10574 - DNA, 518 bp, Canis familiaris
  misc_feature (273)..(273): n is a, c, g, or t
gactgaagtaagtcctcccgagaaggagggcaagcgggaagacgcagcccaagggaagttcacaggcagcctccagataaatgacacggatgagacgcctgataaaactgctgcggccagtatcaaagcgcccttgcgaccgagaaagcactactccttcacggaagccaccgagaacctgcatctcgggctcccggccttgggcgggccggcgggcacaggcgggccgcgaggcagtctcagcgcgggcaagccgcacgggagcgcgggccncgggccagagcacgcggtgagcgggtacgagccctcctttggcaagtcttcccgaacaaaggccaaagacacgttcagggataagaaaagaagtctaatggaggaactctttgggtcgggctacgtcttcaaacacgaccaggcctgcacggctgcccctccacagctcgaggagacgccggaaagtaagatgcaccatctaccccccggccaggcctccgccagcaacgctttcagagattcta

SEQ ID NO: 10575 - DNA, 350 bp, Canis familiaris
gcagccacagagattcaggcctggtggcgtggcaccctcgtacgcaggacactgctgcacgcagctctcagtgcctggatcattcagcgctggtggaggctgaccttggagagcctgctgcagaagaagcgaaaggcagccttggttacctacgcaaatacagagagggcagtggtcaagatccagtctttggtccgtatgtggcgtatccactggcgatactgtcaggtgctcaacgccatcgatgtcatccaatgccactggcaatgccacaactgctatacctgtgctctcctccggggacactgtgtagtcacagccactcacctccagttccacattgagatcat

SEQ ID NO: 10576 - DNA, 204 bp, Canis familiaris
  misc_feature (47)..(47): n is a, c, g, or t
  misc_feature (151)..(151): n is a, c, g, or t
atgtggctcactcgccagcgatactgccggttgctccacgcggtccncatcatccaggtgtattggcgctggcataattgccacacccgtggctttttccatggcagctatgacctcacggcaacccatctgggacttgaacttgagatcnttctggggtcacagatatgtcggattacagactgcatccccttcccaataaag

SEQ ID NO: 10577 - DNA, 178 bp, Canis familiaris
tgcgcagccgggtaagggactggcagaaagggtcccacgaactggcgcgagcaggggcccgcttaccaagatgagctgcacataccccccaagggaggaccacttcctttttcttggctgccgctttctgaaaggagtgagctatcatcagtgctgtgaaataaaagtctggtgtgcc

SEQ ID NO: 10578 - DNA, 368 bp, Canis familiaris
  misc_feature (114)..(114): n is a, c, g, or t
  misc_feature (129)..(129): n is a, c, g, or t
  misc_feature (244)..(244): n is a, c, g, or t
ttttgcaaagacatgactctgctgaacacaaagctggggatgtaccaaaagcaagaagagaaactagactctcagagtcctgaagaaatgggtatggaaggaagtgagcccctncttcctcaggtggcnccagccccattagtgcagaacactgctcctggcattacaatgtggaagcgtgcactgaggattttcatcatattttatgtcctcaccttcactggactttcatgttacatactanttttcgatgctacatttatctttgaaagcttactccctgcaatgctcggtcgccgcagaatgtgggaactacgggagatcattgagcctttcttgaacttggaggtggaagacttgttaccctc

SEQ ID NO: 10579 - DNA, 292 bp, Canis familiaris
tcccagacgggaatcatttccctgtacgactgcatttttaagaggaacccaggctacaatcagaaattgcaccgagatgacagagagcatgcaaaaagcctgggacttcacgtgaacgaggaggagcgccagcggcccgtgggagtgctcatgtcctcggtctacgggaggcgcatacaccagcccgtggagcccctgaaccgggaccacggccgtgccagccacgtgaaggctgacttctacaggaagaatgacatccccagcatcaaggcgcccagctttgggcacattt

SEQ ID NO: 10580 - DNA, 395 bp, Canis familiaris
  misc_feature (140)..(140): n is a, c, g, or t
  misc_feature (349)..(349): n is a, c, g, or t
gagaaagcagctcttgaccgggactcacagctgaaagcaatgaaagagactgtccatctctgcctgtcaactgtgttccgtaatcagcctccccctttgagtctgaccaggtcaaatccaactcagatgccagttccacncgggtcagttggccctctgatttctgatgcaagtagaatgcagcctccgcaaacctttcctggaaggaatgagagctttcaaattgagacaacaagggaagaaaatccgagcaccaccgagtgcaattctcaaaagcttttacaagagggcaggacctgcttaatgaagccgaaagacaatcaatcaagcagtgtcactatagagccantgactaccccaaagaaattgcaaatgcctccttgtactgaatgtga

SEQ ID NO: 10581 - DNA, 442 bp, Canis familiaris
  misc_feature (26)..(26): n is a, c, g, or t
  misc_feature (29)..(29): n is a, c, g, or t
  misc_feature (42)..(42): n is a, c, g, or t
  misc_feature (46)..(46): n is a, c, g, or t
  misc_feature (48)..(48): n is a, c, g, or t
  misc_feature (57)..(57): n is a, c, g, or t
  misc_feature (81)..(81): n is a, c, g, or t
  misc_feature (101)..(101): n is a, c, g, or t
  misc_feature (128)..(128): n is a, c, g, or t
  misc_feature (130)..(130): n is a, c, g, or t
  misc_feature (140)..(140): n is a, c, g, or t
  misc_feature (185)..(185): n is a, c, g, or t
  misc_feature (241)..(241): n is a, c, g, or t
  misc_feature (417)..(417): n is a, c, g, or t
gaaaacctcatcgtctctatgatggnagncctctgtatcagnaacngncctcagaancctgggggcctacctgtctctaangcaactggtgctacggggancagcaccatacctactgtgactggacnanatagtggtcncccattcctacagagcacacagaacccccccaagccacagcactngtggtgcaatgggggataccaccatgcatcttagaactctctgctcttggaacacngtggacctgcccctagtcagggcacccctctgactttggtgagccagcactgtgtgtgcaagttcttggtccactgttctgtgctctgggcgtggctaggtaccttcataacctgtctaggagccaccacccactggttccttccttttgtcatgaatctcaacatctatggaacnagatactcctccacatattttatgt

SEQ ID NO: 10582 - DNA, 336 bp, Canis familiaris
gtacccctcgtggacagattggccacaggggatgttgaagcaacactaggatgtccagcttccagcttttgcttcttctgggaagccttccctgattttccccaattgggcaggaatgaccaggcagcaatctgatggacacagcatgcacctgagatcattgatcctgaccatattcttgtgaagttggttttatcatttcttctcgaatatgagaagatggtctcagaggaaggacctttgaccaagggcagcaagcggatatgcgctgagccgtgattcaggcgcagctctgtctgatgtctccgtgttgctgtgctacagttcaccagagat

SEQ ID NO: 10583 - DNA, 175 bp, Canis familiaris
aggtctagtgcagctggaaccccgggtccccaggtcacgtccgaaccacaatttcaagatgatgttagaaactcagacttgccactgctacctattcttacaggaactgacggttactttttgttcccctaagtaagccagacactttagagcacgtcaacgtggacgggccaga

SEQ ID NO: 10584 - DNA, 348 bp, Canis familiaris
gtttgttgtgtttgagagccctgaggacgaagcctggctgtcccctgggccaagcctgtggcagtggagggctgaaggcactcccaccagaggaagcccacaaggcccattcccagctgtagatgctgggccggtgtctgctgcaaacatccagtgcagagtgtctcaatcgaatgatcaattctctggccacttgtcatgaccggcagtaaactaacaaacaggaacaggctagaacaaagaggaaagtggagatgcacggcacacggcaagatttgcagagaagctgccaagataataaagttcctgtgaacccttcatgcagcttctcctcagtctggcatttat

SEQ ID NO: 10585 - DNA, 355 bp, Canis familiaris
caactcgtactggtactgggatcatgaggaccatgacatcgctgctaggctgcaactgagcgggatgctactctcacgaccccatctgctctttggccgctaccacatgctagaggggcaggaccccagccaccagcaaagcccccagaggcactgctggcatcgtcctgtgaggatggttgaacagtgttcacccaacagaataccatgcaaccagatgcagcacgaaaagaacaagtctctccctgtatccagtgttttcctgttgaggaaagccccatgctgtgcaggattattttgcttctgctgattcctcactgcacggctggcatcttcccgcaggtcttctgaaatg

SEQ ID NO: 10586 - DNA, 57 bp, Canis familiaris
ttgttaccctcctaaagatatagaagttactgctgctctactgactttctccttaat

SEQ ID NO: 10587 - DNA, 569 bp, Canis familiaris
  misc_feature (27)..(27): n is a, c, g, or t
  misc_feature (164)..(164): n is a, c, g, or t
  misc_feature (186)..(186): n is a, c, g, or t
  misc_feature (188)..(188): n is a, c, g, or t
  misc_feature (226)..(226): n is a, c, g, or t
  misc_feature (235)..(235): n is a, c, g, or t
  misc_feature (256)..(256): n is a, c, g, or t
  misc_feature (271)..(271): n is a, c, g, or t
  misc_feature (451)..(451): n is a, c, g, or t
agcggccgttgtgacgtttttctctcngcccagctgtgtggaccgtgccacacgccctccgaacaacaacggctcttgcgtgcatatttcagtgtttcttttgtcagagaatccagcagagccgcaattcgtccagggccagccctgagctgagcgaggagtgnccagccgagatggtgaagatgncnaaatccaaaactttccaagcttatctgccaaactgtcnccgaacgtncagctgtgtccactgcagagnccacctggccaaccncgatgagctgatctccaagtcttttcagggaagtcagggacgagcctacctcttcaattctgtggtgaacgtgggctgcggccccgcggaggagagggtccttctcactgggctgcacgcggtcgcagacatctactgtgaaaactgcaagaccacgctcgggtggaaatacgtgagtancccggccccgcggcgaccgcacggacttcgctgcggtaaccagacacggtacagacggaaacaaaatttgcaaaggagttaagacctcccactggaagcctcaaagaatccgtgtctt

SEQ ID NO: 10588 - DNA, 62 bp, Canis familiaris
attttgcgtctttgtacctgactcatgtgtccaaggggccttctgggaaactggttaatgaa

SEQ ID NO: 10589 - DNA, 231 bp, Canis familiaris
  misc_feature (27)..(27): n is a, c, g, or t
gtttcttataacacatcctatgctgtntgcctgaagcttacagaaacctgttcatgtaaaggaaactgacatcacctgagccatcttgcttttctgtcaagcactgacaattcaggaacccctttcctcctttcctccccaaaggccagtgacagagcaaaggagagcatttccattgtaaagatgaacaacatttaaaagagagtcaaactagtgttgacatgtacatgt

SEQ ID NO: 10590 - DNA, 549 bp, Canis familiaris
ttctgccaagaaatgccctgtgactacctcctctctaatttttatgaccttctcatacaacaaacaccaatccagttcttcccttccctttttcagcccatgggtaattactcctttgagggaaaattcaagagcctcaaagataaagagtttgaggaaaatgaccctagttctcccagcaaccctgctgcttccatctacactaacctgaaagttgccaatatctctgttctcgtgaatgcctatagcttagataagaatttcttttatgccaaatcggctgaggctggcaatcatctgactgtggttttggatgtacctgccagagtatcccgagttcaagtgctgactggctctcacctaaaaggcaagaatcacctggaagagggacaagtagaactgggctatgatgctactaatagagtccatgactgtgatgactatattctcctggggctactggaaaatggcaccctgaataagcaggtgttatctactgagtctggaaagaaggtaaaatgtgtgagactgcttgtgatagccactcca

SEQ ID NO: 10591 - DNA, 441 bp, Canis familiaris
  misc_feature (258)..(258): n is a, c, g, or t
agccagaagttagcgttcccttcaacaactgcttctgagaacggagctgaggaatacatttgggggtgagagagaaaccagatgtggaggcaaagctgtccagtaccatctggaaagcactctgacgaatggtgggggcgatgtaaaggtaaataaaagagctcgagcctagactacaggtgtgatttgccaggaaagacacacacagaagcacgttaccaaaacctgagcagaggaccaggaaggctgctgagtgtnccaccggcctggggttctgcactgcaattctagtggctcggtctttaaaatcctatctccgaggtactgatccgtagcattgcttcttctgtgctgacccccttgtcatggttttgtctgctctcgaaacctgagattttttggaatttgttgcctcattacactgggctttacacacatgag

SEQ ID NO: 10592 - DNA, 494 bp, Canis familiaris
gaaatcctcaaagtggcaatccctagactggcaaaatgaaaattcgcaatctctaaagtcacctaatttagagcaacaaaacaaaagcttgcaatctccaaaacagaaagccccagaccagcaaattcaaggccaacaatccctaaaaaggaaatccctagaccagcacatcaaggattggctatctccaaagaggcactctatagataagcaaatccaagttaagcaagacagacagcaacacctagatcagcaagctgaggtccaggtggtccaatgggaacaattacaaaggcaaggtgaagatcaacaggacggagagaagcaatctccaatgagacaacacaaagaaagacaagataaagctctacaggtttataaggggcaagccatcaagaaacaaagcaaataccagcaaactgaagacctgcaggtacaagaggagaaatctctaaagcagccacatcaagatgggcaactccaaatccaggaac

SEQ ID NO: 10593 - DNA, 475 bp, Canis familiaris
  misc_feature (192)..(192): n is a, c, g, or t
  misc_feature (296)..(296): n is a, c, g, or t
aatcctgtatttctggtatttcctccagagatcactattcctgatgtgcagccaacagaccttacagccccaacctttgagtctaagagtgcttttccaaaattacttgctacaaaaatgaaaatcttaggggctatgcagatcctatttggagtgatgaacttttcttttggagtcattttcattttcacnctggaaaatccatacccaaggttcccctttatatttatttcaggatatccattctggagctctgttttgttcattaattctggagccttcctagttgcactggnaagaaaacccacaggaactctggtgaagatgagccgaataatgaattttcttagtgccctgggagcaacagctggaatcattctcattgcatttggtctcattctagatcaacactacttttgtggctatgttcaagcagttagtcagtgtcaaggcattgctaccctattcattggaa

SEQ ID NO: 10594 - DNA, 170 bp, Canis familiaris
aggtccggcagcagagccgcagcctaaagctgggcagtgctcccttccctcggggcgacctggcgcacctggagcggagcgtggggcgcctgcgcaccatgcactccaagatgctgatggacatagagaaggtgcagatccactttggaggctcggtcaaggccagcagc

SEQ ID NO: 10595 - DNA, 481 bp, Canis familiaris
  misc_feature (26)..(26): n is a, c, g, or t
  misc_feature (181)..(181): n is a, c, g, or t
ataggagtggctattcctccatcaancaagatgccccttcctgatgggaggaggttcggagcccaggcctagagaacgagtccgcactcgttggccaggacggggcagatgtactttccacagcttcctctgcatgttctctgtccagcatcaatatttccatgttcgggatgaaacagangttacctaacatttaaaggaatgactttctcctttcaaaacaaggaggaatgtgcagtatcaaatctggattccagaaaccctggcacaggacgaccctgtgtcccaaactttcttgccaaggttccagtttatgcccacgaggcccagagaaggttccggatgtggcggcagcttttggctctgaatggttttggctgcaagaactacccggtgactgatttactcctcgatttcgagtcttttttccccccctccatcaaaataattctccacgaatcatttccatgtttccaaggca

SEQ ID NO: 10596 - DNA, 289 bp, Canis familiaris
cggaggcggcgatggaaccggccgagccgcttagcgacctggtgtccgccgagggccgaaaccggaaggcggtgctgtgccagcgctgcggctcccgggtgctgcagcccggggccgcgctcttctcccgccggcagcttttccttccctccatgagaaagaagccagctctggctgacggcagcaatcctgatggcgatctcctccaggaacactggctggttgacgacatgttcatcttcgagaatgtgggcttcaccaaggacgtgggcaacatcaagtttctggt

SEQ ID NO: 10597 - DNA, 249 bp, Canis familiaris
ttttccttccctccatgagaaagaagccagctctggctgacggcagcaatcctgatggcgatctcctccaggaacactggctggttgacgacatgttcatcttcgagaatgtgggcttcaccaaggacgtgggcaacatcaagtttctggtgtgcgcagactgtgaaatcggaccgattggctggcattgcctggatgacaagaacagtttctatgtggccttggaacgggtttcccatgagtaactga

SEQ ID NO: 10598 - DNA, 483 bp, Canis familiaris
  misc_feature (51)..(51): n is a, c, g, or t
gcgctgagcggaaggcagttttcttttgtttctgtaggagaggagcggacnccagacatgtgggaggaggaagtgatgggaagcccaggggacatggaagccccgcgagactgaagaagcactttgaggaactttcgagaacttgtttatacatcaggactgctggcaagagacctctctcttctctggcttcgtgagaaggggtgagggcgcgtgcaggatggctgtcgggagctaaaaccactcaacaggtcacctagagcgactgattaagtgccttgcaaatctttattatccaaacgtttatgttcagactttctcgtgtacagatggtgctagtccagatgaaaacaccaccacacacgcggaaatcaagcgcgtttttgaaatgtatttccagctcgttttctcttggtgttttatcctgtttctgacttgctgtttctaagtagtatttgtagatctattccctactcggtattg

SEQ ID NO: 10599 - DNA, 319 bp, Canis familiaris
gcaccatgcactccaagatgctgatggacatagagaaggtgcagatccactttggaggctcggtcaaggccagcagccagatgatccgtgagctgctgcaggcacagtgtctgagctccccctgctacaaacgggtgccagaaacggctgactacacgtactcgagcgtgcctcggcgctgcgggggcagccacacgctcacctacccctaccgccgcaaccgcctgcagcacccgtcccagggcctgtaccccaccgaggaggtccagatcgccatgaagcatgacgaagtggatatcttgggtctggatggacatat

SEQ ID NO: 10600 - DNA, 363 bp, Canis familiaris
gcagcagtttgtacatctggcagatgaggacaactgaggcaagttgaagtaacttcccagacccatgtgaccagcaagagatgacaagaacctctgagttcatccacaccacgaacctcacttgggattccactgggcttaaggaagagaatctggggagcagcaaagtgaaggaaccagctttgtccaacttggagctcatggtttcaccagaaagggagctcggtctctgttccctgcattctagctcccgggtcccatcagcattccatggctatgtctgatgttcccttcaaatgtgccttagggatgcctgactggcccagtgctcctagtggagcacaggactcttgatctagggtt

SEQ ID NO: 10601 - DNA, 300 bp, Canis familiaris
  misc_feature (249)..(249): n is a, c, g, or t
gaacgtaaagaacagtcccatcccaagaaaaactctgaagatgattcagccttctgcagctggatcacttgttggaagagaaaatgagttggttaaaggcttgcccaaaaggaaactttggaatgaccagttaacatctaaggcttccagctcaggagttgtcactgtcccagaacatagtgaaaataaaaatttttttgaaattactctagaagcatttgatcttatggttgcagaaaatccatcctnccaattttggaaagaagtggcagaaaaacggaggaaggctctctacgaagc

SEQ ID NO: 10602 - DNA, 568 bp, Canis familiaris
caagacctaacattgtacctcctgaaactattgacaaacagtgggcactcgttggtgagcacaggtgatcgggaatatatccggaacgtaaaagaaaaatgttgctatgtggctctggacttcgacaaggagaaagtgaaagctgactgtccttcctacgcacagaagtatcagctgcccgatggccaggagatcacccttgggcgggagaagttcttctgccctgaagggctttttcaggcagatctcatagggagacgtgagccaggcatccacatgaaggccttccagagcatcagctcttgcaattctgccctctggaagattctcttcagccacatcgtattgtctggaggaactggctcctgttctggcttgtgcttccggttgcagaaagagatatctgccctggtttcccctacgattaacgtgaaggtgtccacctgcccctactccacttacagtgcctgggtgggcggctccatcctgtgctcactctccaccttcaaggacatgtgggtcactagcaaagagtataaggacatcggtgcctctatcgtcagtagga

SEQ ID NO: 10603 - DNA, 134 bp, Canis familiaris
tttttggaattcagtgcgatctgtaagtcgatgtcgaagcaggagtttaagtcccatctgcccccgtagccgtattggtttaagcacgctatctcgaagccggagcccttctccaataagatgtggattgccaa

SEQ ID NO: 10604 - DNA, 343 bp, Canis familiaris
gacatggtcaacaatctggctgcctcccggccctccaagaaagccaagctccagagccaggacgaagagctgctgggccacgtccagagtgccatcctgcaggtgcagggcgactgcgagaagctcaacatcaccaccagcaacctcatcgaagaccatcggcagaagcagaaagacattgacgtgctgtaccacagtctagagaagctcgagaaagaaaaggccaatagggagcacctggaaatggagattgatgtgaaagctgataagagcgccctggcagccaaagtgagccgcgtccagttcgatgccaccacggagcagctgaaccacatgatgcagg

SEQ ID NO: 10605 - DNA, 350 bp, Canis familiaris
aacccatgacatattctgctacctgcaagactgtagtggagacatgttttattcctaaaaattacttgtatgaagcttttgaacaatgtagtcctcacattgaatataaaatgtggctaaaacttggactttctattactgccaaaaaaatcagggaacatctatcttatgaggattggaactacaagatgcaattaaaactctgtaatgtgtctgtaaaagatataccaaagaacatcaaaactggtatctatgatgaaactgtgatttatgtcatcctcatccatggagctgtagaagattgtcagttacggaaagcttataaggcaccttctttaattcctataaca

SEQ ID NO: 10606 - DNA, 149 bp, Canis familiaris
  misc_feature (28)..(29): n is a, c, g, or t
  misc_feature (31)..(32): n is a, c, g, or t
tggattgccaaggttttaaggccacccnncnngttcctttgccacagtacatctgcaacagccaactttcccagcatctctatctcctctgcctgcctcagaactcacttaagataatgtgaaaacgcaattctgtgtatcactccaca

SEQ ID NO: 10607 - DNA, 503 bp, Canis familiaris
  misc_feature (31)..(31): n is a, c, g, or t
  misc_feature (73)..(73): n is a, c, g, or t
  misc_feature (102)..(102): n is a, c, g, or t
  misc_feature (106)..(106): n is a, c, g, or t
  misc_feature (111)..(111): n is a, c, g, or t
  misc_feature (192)..(192): n is a, c, g, or t
  misc_feature (236)..(236): n is a, c, g, or t
  misc_feature (251)..(251): n is a, c, g, or t
  misc_feature (294)..(294): n is a, c, g, or t
  misc_feature (322)..(323): n is a, c, g, or t
  misc_feature (432)..(432): n is a, c, g, or t
  misc_feature (458)..(458): n is a, c, g, or t
tcctgctttatgtcagcataccgggggcccncctgatgcaagcacagatgagaacatcatcgtgtctatgatngcagccctctgtatcggcaaccgccctcnaganccctnggggcctacctgtgtctaaggcccctggtgctcccgggaacagcaccgtacctactgcgactggacatcataacggtcccncattcctacagagcacacagaacccccgcaagccacagcactgntggtgcaatgggggntaccgccatgccttttagagagaaatctccactcttggaacangtgggcctgcccctagtcagggcacccnnctgactttggtgagccagcgctgtgtgtgcaagttcttggtccactgttctgtgctctgcgcatggctggggaaccttcatagcctgtctaggagccgccaccaactgnttcctttcttttgtcatgaatctcancctctacggaacagacattcccccacatattctgtgtcatagtaa

SEQ ID NO: 10608 - DNA, 475 bp, Canis familiaris
  misc_feature (27)..(28): n is a, c, g, or t
ggatcgcctctgcaacaatgtttgatnnagctaaagacatggcttactgtgacacacagctccgtgtggcctttgacggggatgccgtcctcttctctgacgaatctgaacatattgccaaggagtatgggctggacaaattctttcaacatgaaacactatttgaaaataagcctcttgctcagggtcccttaaaaggctttctggaagatttaggcagactgcaaaagaagttttatgccaaagacgaacggttactttgccctatcaggacctacctggttacagccaggagtgcagccagttcaggcgcccgtgtgctgaaaacccttcgccgctggggtctagagatagacgaagctcttttccttgctggagcccccaaaggtcccattttggtgaagataaggccccacattttctttgatgaccacatgttccacattgaaggggcacagaagctcggcaccatatc

SEQ ID NO: 10609 - DNA, 108 bp, Canis familiaris
gctgaaatcatctctttgtcctttaacacctcaggagacagaatcgtcacaggatcttttgatcatacagttgcagtgtgggaagctgataccggaaggaaggtgtat

SEQ ID NO: 10610 - DNA, 431 bp, Canis familiaris
ggtgtataccttaatcgggcattgtgctgagattagcagtgctttattcaattgggattgctctctgatattaactggctctatggacaaaacctgcatgctgtgggatgcctcaaatggaaaatgtgtggcaacgctaacaggccatgatgatgaaatactagacagctgtttcgattacactggaaaacttattgcaactgcttcagctgatggaacagcaagagttttcagtgcagccacaagaaagtgtcttacgaaattagaaggccatgaaggtgaaatttcaaagatttctttcaacccccaagggaatcgtcttctgactggcagtgctgacgaaacagctagaatctgggatgctcagactggtcagtgcctccaggttcttgaggggcacacggatgagatcttttcatgtgctttcaact

SEQ ID NO: 10611 - DNA, 476 bp, Canis familiaris
  misc_feature (157)..(157): n is a, c, g, or t
  misc_feature (341)..(341): n is a, c, g, or t
attttacggacagattccctggcagaagttctccagtggctgcttcatgcaagctcaaaagaaaaagagtggatctcagctttgattcatgctgaactggctgaaataaacttgttggctaacgaaagaagcatctcagcagaactagcagcagagnataataagccacccaaagttaaatctccccccatattcacctgcaaaaaagtgctgaccaaatcgagggaaggacatcagccaaccagagtgtcaagtcaaggatctgaaggaaataaggaagtaccaaaagaggctgagaacaggcctccattgtttatcagaagaaataagatgaaaatacncgttgcagactatttcagcaaaccaaagtctcctctcaggcctaaaactcaggaaagcatatcaacaaaaccaatgtcagcaaggagtatgcaacaaggatacaatccctctccccagagagcattttatcctta

SEQ ID NO: 10612 - DNA, 582 bp, Canis familiaris
  misc_feature (381)..(381): n is a, c, g, or t
aattctgtgattcggactcaaggacagaagaaagttgctagcatgatggaaagtaaagatgtccacaaaggaatatttcagattgagtgggaacataagaaaatggagatggaaatggaagatctaaatcagaaggcttgggatattcagatgctatttttttcaagagatcgtcaaaagtacctaaatgaaccaaactatgagactctgattgccattcagattggaataatggagcaaaccattgctgttttagagaagacccacaaaaagaatgtggaaaactgcaaaaaactactaaaaaaactgggaaggtacagcaatcaaaaagatatagcaaattatactctaagctgcaatttacgagaagagctggttgcngtctccgaaaggaaagagatctgtaatgcagtggggtctaaactgacttgtgaaaagattgccaaagaacgatatgaaaacatgatggaacaacaaaagttaacaaatattgcaaaacaacaagctgaacaaattttaatactgcagactgaacttgaacgattaaggatgaaaacatttcctgcacttgttcaaatgtaa

SEQ ID NO: 10613 - DNA, 583 bp, Canis familiaris
tctggccacgaccacattgtggtgaccggccctgcggggcccgaggagctctgggagctggtgtgggagcacggggcccatgtgctggtctccttgtgcccgcccgacacctgggagcagtcctggcccacggagacgcagcccattgtcacagagacagtgacggtgcagtgggtggcggagagcgtcacggcgggctggccctgcaccctcctgagggtcacgcacggggagagcaagaaggagaggcgggtgcagagactgctgttcccgtgctgggagccggggcgtgagctccccgccaccaccatgctacccttcctggctgccgtgggccagtgctgctctcgggacaggacgaagccggggaccctgctcagccactgcagcagaggtgtggcccagctgggcactttcctggccctggaccagctgctgcagcaggcgggcgtggagtgcaccgtggacgttttcagtgtggccttgcagcagtcacaggcctgtggcctcatgaccccaacgctggagcagtacatggacctctatcactgtctgaacagcgcactcctggatgggctgcctt

SEQ ID NO: 10614 - DNA, 248 bp, Canis familiaris
agcaaatgtcagttgatctacgaatctgtcatcgcttgcgaatacctggatgatgcttatcctggaagaaagctgtatccatatgatccttatgagcgggctcgccaaaagatgttattggagttattctataaggtcccacatttgaccaaggagtgtctggtagcattgagatgcgggagagaatgcactgatctgaagctagccctgcgtcaggaattctgcaaccttgaagagattcttggcta

SEQ ID NO: 10615 - DNA, 516 bp, Canis familiaris
ggtgcccagcagaactatgccaggaaatacaccatccccattgatctccttgggtttgactatgaagtgatggaagacaaagagtataagtatgctccagaagatgaatttgatcaatatgcatgtttaaaccgttgtattaacctgcttcttttgtatttaggggttttcattcatggattatttctggatggagcttcctggaatagaaagatcaagaaacttgcagaatcacatcccaaaattctttatgatacgatgcctgtgatgtggctaaagccctgtaagagggcagacataccagaacgaccaagctatgttgctccactgtataagacaagtgagcggagaggaacattatccaccactggccattctacaaattttgttattgccatgactcttccctctgatcaacccatggagcactggattggacggggtgtagcattattatgtcaacttaattcgtaattagaagataccatttccctgttaccgttttcttgttagatg

SEQ ID NO: 10616 - DNA, 541 bp, Canis familiaris
gaggcgtaaacagcttatccgagaaaagagagagatggcaaaaactataagcaaaatggaagaaacggtccgccaactaatgatcagcaagtttggccgtgtgatcgacctagaagcccttcagacactttccgtgaatactacacttgaagagctaaagatcagaaagattcgaaaggagctactgaatgcaaaggaaatgaagatgtgggaggaaaagattgctcaagtgcgatgggagttgatgatgaagacaaaggaacacaccaaaaagcttcatcagatgaatgatttatgcattgaaaagaagaaacttgattctcgactgaatacattacagaaccagcagggcaatgccttccagggccctcggaaagcagatattgtggcaaaagagaaggtcgctgaactgatccaactccaggcagaaaggattttggccttaaaggaagagattgctctcttgcgtaagaaaggtggtcttatcctcccgcccattcagcctccacaagagaaggagatgaaccccatgggtctttaa

SEQ ID NO: 10617 - DNA, 88 bp, Canis familiaris
gaagaggtagactgaagcatcagaagagctatcatctggaatactctaactgggatcctgtctacattggtctcagcatagactgtgg

SEQ ID NO: 10618 - DNA, 532 bp, Canis familiaris
gtgtggatcgccctatacaacctgctgctaagccccgaagcccggacccgctactgcgtcaccagctttgccaagggacagctactcaagcttcgggccttcctcacagacacactgctcgaccagctgcccaacctggcagacctgcagggtttcctggcccacctggccctgacggaaacccagcccccaaagaaggacttggtgttggaacagatcccagaaatctgggagcggctagaaagagagaacagaggcaagtggcaggctattgccaagcaccagctgaggcacatattcagcccttcagagcaggacctgcgactacaggcacgaagatgggctgagacctacagcctggacgtcctagaggcagtaaccccagagcggccccgctgtgcctactgcagtgcagatgcctccaaacggtgctcacggtgccagaatgaatggtattgctgcagggagtgccaagtcaagcattggaagaagcatggaaaggcttgtgtcctggcagcccaaggtaacagag

SEQ ID NO: 10619 - DNA, 125 bp, Canis familiaris
cgagggcagcagcacgtcggtggaggacctgtcagggagcaagcctgagccagatgccgtttccgtggcctccgaggcctttgaagatgataactgcagcaacttcgtgtctgaagatgactcgg

SEQ ID NO: 10620 - DNA, 125 bp, Canis familiaris
gaagctgtgagcttcgctatcacctccgccagagttttgtctacactgctggcggcagctggccctgagggcagtctaaacttccagaccctgacttttaactcaggaataaaagtctttctgca

SEQ ID NO: 10621 - DNA, 62 bp, Canis familiaris
actgctggctactgacaaaggcgtgccctctgaatgggacttataaacttcagccctgggga

SEQ ID NO: 10622 - DNA, 490 bp, Canis familiaris
  misc_feature (59)..(59): n is a, c, g, or t
  misc_feature (434)..(434): n is a, c, g, or t
aagggctcagacttttcctcggcagcagtactggcctctgtatcagtctatgcctcctngctccccaagtcaggctcggcctaggacacagtcattggagaggaggcatcagggtctgaattcatattcacccaagggcaataacacttaggaaatgaactgggaataaggagtaagattcccttggcaaatcctccttcccttcccaatggcttcacttggtcagaagacctagactagttacatactagcaatccttgttttgggactcctctacctgctgggttcagcactgggatcttactcccagatcacaacgctaaatactaagaattatctctgaattccctacctaggcttaccttatttcaccttcagcagatattctagtgaaagattttcttctttgcactccccatacttctgaggatacngtccaaccatctctaacttactcctctcatctctgtttccctttctccaaagagat

SEQ ID NO: 10623 - DNA, 419 bp, Canis familiaris
aagccactgggtgaacagccttcaggcattccaccttcaagcacattttcaggcccaatattaaattgtcacacatgctcatatatgaatgatcaaggaaaatgtcttcgtggagagggagtctgctccactcagaattcccagcagtgcatgttaaagaagatctttgaaggtggaaaactccaattcatggttcagggatgtgaaaacatgtgcccatctatgaatctcttctcccatggaaccaggatgcaaattatatgttgtcggaaccaatctttctgcaacaagatctagaagcctgtgcccttgcttcctaccctgactcaggcagcaaaaatcctccatcacccaatatggcccaatttatgttttgtttcttccccagtcaacaactaattacatctgcctctgagtgt

SEQ ID NO: 10624 - DNA, 163 bp, Canis familiaris
  misc_feature (66)..(66): n is a, c, g, or t
cctgtaactgcctgaaggtgctgggaactccaagcagaggaaggactcctgccattagcatggacnacatgcctccttgcctccccctgccttctctcgccataaccctactcaagagaattgtgagcttctcggagaatctagaatgtatcccattaccccg

SEQ ID NO: 10625 - DNA, 218 bp, Canis familiaris
gtggctgtcgtacgctctaatctttggccaggggcgtatgcctacgccagtggcaagaagtttgagaacatctacattggctggggtcacaagtacagtcccgacaacttcaacccacccctgccagcccccattcagcaggagtaccccaggggcccagaggtcatggagatgagtgaccccactgtggaggaggagcaggccctcaaggcagccca

SEQ ID NO: 10626 - DNA, 184 bp, Canis familiaris
gacagttagaacttgtttcctcctccaagtcagccaacaagaggtgctcagagactgtgcccagcagaacaataggggagccaagtggcctagatctactgtggactacctgtttgcctgtgtgtctgcccagctctttacctcgttctcatcagtgacgtctaccattggcttggcaatcaga

SEQ ID NO: 10627 - DNA, 96 bp, Canis familiaris
cctcccccaagcaggtagatagcagcttttcccttacacattgttagcaatgcgttggttttttcacggttgttttgatttctgcccgtggagggc

SEQ ID NO: 10628 - DNA, 563 bp, Canis familiaris
  misc_feature (473)..(473): n is a, c, g, or t
caaaaggcccaaatcaagctccatttgtcgacgaaggcgaataatactcagaatatggaaaggatgaagcaaatagaaacggaattgaggcagatggagctaattaaggatcaatatcagaaaaaaaattatgaacagtccttgagtatccagaagttcgtgtctgaaatgactaacctacagaaggagatgcagctgctggccaagagccaatatgagacgtctgcgcagaacaaacagcaagagctgcgactcgaggcagagcgcaatgttcggcaggaactggagagccggtgccgggaattggaagaaactatcagacacctaaagaaatgtaaagaggcaacagagcataagctgaaagaagccagtgtggaatcagaacagataacagctaacctggaagaagctcatcgctggtttaagtgcaggtttgatggcctccaacttgagctgacaaaaaaccggttgcngaggcttccccgagaagacaggtggctggaagaggaccaaggtaacaggcacgatattgcgtccagccagtctgttctacatcgatggga

SEQ ID NO: 10629 - DNA, 206 bp, Canis familiaris
  misc_feature (155)..(155): n is a, c, g, or t
atgatgtggccgcaataaacccagaacttttacaacttcttcccttacacccaaaggacaatctgtccctgcaggagaatgtaacggtccagaaacaaaaacgcagatcagtccactccaaaattcctgctccaaaggaaggtctccgcagccgntccactcgaatgtccactgtctcagaggttcgcattaccactcaggagaat

SEQ ID NO: 10630 - DNA, 580 bp, Canis familiaris
  misc_feature (414)..(414): n is a, c, g, or t
aagacacccgtggtccaatatgatacctctacgggatttggcctggttctgacaactcctggagaaaagagaggctcggggagcaaaagcaccgagttctacaacgagttatggttcatcgtgttaatggccgtgctaggcctgatcttgttggccatttttctgtctctgctactccaaaggaaaatccacaaggaaccgtatatcagagagaggcctcccttggtgcctattcagaagagaatgtctccgctgaatgtctatccgccgggggaaacccatgtgggattagccgataccaaaatcccccactctgggacacccgtcagtattaggagcaaccggagcatatccgtacttcggatcccaagtcagagccaaataagccaaacctattcccaaggctctctccantgcagtgtcagccaactcatggaccttcaagacaagaaagtcttggttgatgactcgctgtgggaaaccatcatgggccacgatagtggactgtacgtggatgaagaggacctgatgaatgccatcaagggtttcagctctgtgactaaggagcacaccacgttca

SEQ ID NO: 10631 - DNA, 323 bp, Canis familiaris
agcggcatgaggtggccaagtttattgggtccccaccaggctatattggccatgaagagggtggccagctgaccaagaagctgaagcagtgccccaacgctgtggtgctctttgacgaggtggacaaggcccatccagatgtgctcaccatcatgctgcagctgtttgatgagggccggctgacagatggaaaagggaagaccattgactgcaaggatgccatcttcatcatgacctccaatgtggccagcgacgagattgcacagcatgcactacagctgaggcaggaagctttggagatgagccataaccgtattgccgaa

SEQ ID NO: 10632 - DNA, 418 bp, Canis familiaris
tgcgggaacagctcttagaaacagagaggagactgaatgaggctcggagggagcatggcaaggcagtggtctccctgcgccagatgcagcgcaaagccacctgggagaaggagcggaaccaggagctcaggcgcctgcaagatgaggcccggaaggaggaggggctgcggctgacccagcgcctgcaggagctagagagggacaagaacgttatgctggccaccttgcagcaggagggtctcctctcccgttacaagcagcagcgactattggcagttcttccttccctcctggataagggaaagtctgtggagtccagccccagggacccagggtcttcagcagctgtgcctctggcagcacccaccaccagggagtccataaaaggatccctctctgtcctgctcagtgatctgca

SEQ ID NO: 10633 - DNA, 513 bp, Canis familiaris
  misc_feature (402)..(402): n is a, c, g, or t
tctacatcacgaaatccaacggtttaaggccattaaggcatgtcttgatcgaaatccagaagctttccagccaaaaattgggaaagggaagttgggagatgtgaagcctcggcataacaaaggctgtaactgcaggcgctcaggctgtctcaaaaattactgcgagtgctacgaggccaaaattatgtgttcttctatttgcaaatgcattggttgcaaaaattatgaagaaagcccagaacagaaaacactaatgaacatgcccaactatatggaaattggagggtttgaaggcaaccatcatttgtcaccaactaaattctcaggactaccaaaattcagaaaagataggcagtcttcctcgtgcatctcctgggaggtggtggaggccacgtgcgcctntctgctggctcagggtgaagaggccgagaaggagcactgctccgagtgcttggcggagcagatgatcttggaggagttcgggaggtgcttatcacagattctccggattga

SEQ ID NO: 10634 - DNA, 421 bp, Canis familiaris
  misc_feature (243)..(243): n is a, c, g, or t
ggtgaatgcacctggctctacctaagctgcaggacagaccttcagtctgctatggcacaactccactgccagcctgccccagggcctgggggagtggggtcatctcccaatgcccaggagagagtcagaagggattcaggaatctgcccttcaatcatctcaggttgtgggggtttttaaccgacattttctatttttaccactcatccctggtaaaccctgtggactacttccctgtctgtngtggtgtgggtgtttaagatgggagagatgagagccctctcaggccactctgctcagtgcgacagagtgacaaggatggaccatggatgcgctatctgcctgaatctgattcttcaggggtgcagactgaggggtgctgagcatgagctgggaaaaggtttgtggacccttgcagcct

SEQ ID NO: 10635 - DNA, 98 bp, Canis familiaris
tttagccatcttgatcacagctccaaatggagctctaattattggcatactggggcccaaaatacttacacgccatgatccaagcaaaatcaatgtgg

SEQ ID NO: 10636 - DNA, 427 bp, Canis familiaris
aaaacgtccactgaagagagcatttcttatttcgagtttgagtgtttctgctgtcttgggcggccatcgtattggtttacatgcagctggaggattatgcacactagtgttgagctttgttgcagggttaaattggtccacagaaaaggttagagtccaaagaattattaaaactacatggcatgtttttcaaccccttctttttggtttggttggatcagaagtatctgttgcatctcttaaatcaaatgctattggcatttgtgttgctaccatgagtttggcattattgattcgaatttcttttacatttgtattgatgtgttttgctggctttagtttcaaggagaaaatatttattgcattatcatggatgcctaaagctacagtccaggctgtattaggtcctctggctctagaaacagca

SEQ ID NO: 10637 - DNA, 416 bp, Canis familiaris
  misc_feature (64)..(64): n is a, c, g, or t
  misc_feature (68)..(68): n is a, c, g, or t
gaagtggtctttgatttcctcgggcccgctccaggacaggaggccccatctatttcagccttcngctnccgcctctgcttggtcccagctgggggcagcacaaacactgagccccaagcacatccaggtggtttgtgtgggcagctgggaccaggtgctgacagcaggttctacagcgtccttccctgctgctctatctcttgtgagggctgcctggccactgcctctcgccccttctccaaggggctgcaccaagcattctgactgctggggctgcctcctctcctctccataaagtttaagccactataggcatcttttctggttaaaaaaaatctattaaagtttgactatttgatatttttatagtgattgccaactttaaaaagtaggctgtttgtaagcactgatgcagt

SEQ ID NO: 10638 - DNA, 549 bp, Canis familiaris
cttctttccttgatgcaggcacatctcatcgtgctaagcaaaaacccctctcaagaggaggcagcagtctccgcacattttgtcgcccacgcttccatcgcttctgggagacccgagcaccatgatgtggccgagcagtattttcaagagagcatggcgaatcttaaggatgctgaaggaatgggaaaagccaaatttctttcaattcaagatgattattgccattttctacaagtcataggacaaaaagagaaagcaacctcaatcctgagagagtccctggaagccaaagtggcagtatttggtgacctcagtcccaaggtggcagagacgtaccggctgttgggtgggaccgacctggctcaggggaaccacagtggggctcacaagaaactgaagaagtgtcttcagattcagactctcttatacggaccacaggacaagaggactctggccacccagcagaccatggacgtcctggccaaggccccggaggtggccgtgaaacccaggcagacccccagagccaaagcggcgttctgcggctgc

SEQ ID NO: 10639 - DNA, 192 bp, Canis familiaris
tgatgcgctcagtctggtccagggcggccctggacactgggaggaccctggggggccattgaggttcctgcccccaactccccttgaactaagcagtgtgagcaccatcgtgcacagactgcagactgccttccaagaagccatggacctttacaacctggtggtctccaacgaccagatgagcactgatca

SEQ ID NO: 10640 - DNA, 558 bp, Canis familiaris
ctgtgaaattttaggagtccgtgcctataaagcttgtaccgaggcaaatgcaatgtgtggcaggctgcagtgtataaatgtcaacaccatccctgatctgccagagcatacgatcgtcatctctactcatctgcaagcggaaaatctcatgtgctggggggtaggctaccacaaagccatgatacctatgggaatacctgacataggtgtaataaatgatggtacccgctgtggttataacggactatgtattaacagaacttgtgtgaatgattcagtcttggattttaactgttttcctcaaaagtgcaaccaccgaggcgtttgcaacaataaaaaaaactgccactgcatgtatggctgggcccctccattctgtgaggaggtagggtatggaggaagcattgacagtgggcctgcgaggaagcagaaagaggaggtgcctacgccagtacaggtcgtgtccattatgttagtacgccttattttattagtcatctcagtgattgttgtgtttttcaagagaatgataagacagtatatgcaatccaaacagga

SEQ ID NO: 10641 - DNA, 478 bp, Canis familiaris
  misc_feature (102)..(104): n is a, c, g, or t
  misc_feature (106)..(106): n is a, c, g, or t
gaagattttcagcttatgctgcagagactgtgaggagccccactccatggatgactccaaggtccccagtcaaagccaagagcctcagccatcgacctgcannntncagaaggaagagctggccagcaagaatcccaagcgtgctaacgaagcctcccgcttgcctttgggacaacccctgatgggtccagaaaagagagcctcctccaccagcaataatgagcatgaggaagggaatacacatgtttccccgagagatttttacaagagaaacccaacccgctactcccaggatcgctggccattccagccgtgccacaccgggagaccctgagcgttctagtccgctgctaccaggcaggcctccggggctgcacgctgccagcaaggctccgggaggaagggggcagcgagcaggggccatgaagacagattcggaaactccccccgaggaggagaagacgtctgagccacctct

SEQ ID NO: 10642 - DNA, 306 bp, Canis familiaris
  misc_feature (106)..(106): n is a, c, g, or t
tccaagctcaggcaagacatattttgtcatctgtgcaagaatttacaacaactcaggatagttcaacacttgtgagtgaagaaattagctaccttactctggaaancaaatctctacagaagcaccttgctgagcagcagcagcagtaccgtgtaaagattaatgaggtggcatcagaactaagcaacacacagaaggagatggatgacttgaggcaacatttagacaaatctttggaagagaatagtagcttaaaggctcttttgttcagcatgaaaaaagaagcaaaaaatgcagacactgcgg

SEQ ID NO: 10643 - DNA, 441 bp, Canis familiaris
taaagattaatgaggtggcatcagaactaagcaacacacagaaggagatggatgacttgaggcaacatttagacaaatctttggaagagaatagtagcttaaaggctcttttgttcagcatgaaaaaagaagcaaaaaatgcagacactgcggctacattaaatgtgcagatcactggacttcaaacaagtgtgaagaggctctctgatgagattgtggaattaaagcagcatctgacacactatgacaagatccaggagctcacccagatgcttcaggagagccacagctccctggtcagcaccaatgagcatctcctgcaggagctgagccaggtgcgggcacagcaccaggccgaggtggagcagctgcattggagctacaaggagctcaagaagactctagccctcttcccacatggtagcgccagccttggaggct

SEQ ID NO: 10644 - DNA, 260 bp, Canis familiaris
gagcatggacggacatcaagcctgtgaaaccgataaaagccaggccccagtacaagcccccagatgataagatggctcatgagaccagctacagtgcccagttcaaaggggaagccaataagccgacaccagccgacaataaggtcatcgatcgcagaagaatacgcagcctctacagcgaacctttcaaggaacccccaaaggtggaaaaacctagcgttcagagttccaaaccaaaaaagacctcagcgacccataag

SEQ ID NO: 10645 - DNA, 99 bp, Canis familiaris
gataatcctatgatcgttagtccattagagtcgaagagtgacacacactaattaagagacaggcatgtgcaagtgtttatccctcagttcagactagac

SEQ ID NO: 10646 - DNA, 200 bp, Canis familiaris
aaattgaaactctagggcactcccgctgcctcttctctagcggcagacaggggaggccctggtcgaggtgtcccaagccgccatgtttaggaaacacagtgtaccctgctcccagcatcaccaggcacttgcccacaagtctgtcccaacacagccctgggccacctcccccctggggagcgtataaagaagcttgctaa

SEQ ID NO: 10647 - DNA, 240 bp, Canis familiaris
atgactctaatgtggcttctacaagtgaactagaagaccattagatgacttgggatgtcacttgggagctttgagaggctccacaaatctgggatcccagaacaataaacagcaatgatcttttgcactatcaagcagacctctgattgtacctaacaagatcatttctctggatctttaattactctgaggcatgtgtcctatctccatcattaattggctatacaccttcatacaagc

SEQ ID NO: 10648 - DNA, 399 bp, Canis familiaris
  misc_feature (111)..(111): n is a, c, g, or t
  misc_feature (121)..(121): n is a, c, g, or t
  misc_feature (131)..(131): n is a, c, g, or t
  misc_feature (138)..(138): n is a, c, g, or t
  misc_feature (150)..(150): n is a, c, g, or t
  misc_feature (196)..(196): n is a, c, g, or t
  misc_feature (216)..(216): n is a, c, g, or t
  misc_feature (219)..(219): n is a, c, g, or t
  misc_feature (221)..(222): n is a, c, g, or t
  misc_feature (225)..(225): n is a, c, g, or t
  misc_feature (234)..(234): n is a, c, g, or t
  misc_feature (236)..(236): n is a, c, g, or t
  misc_feature (268)..(268): n is a, c, g, or t
ggaacagcctgggtaccatctgcctgtggagctggagccagacctggatgggccgaggcaagcagtccactctggcagtggtggtcttggctcggctgcagtggtcccccnccaagctggnctacttctcnctgagcncctgtcccgatnaggggatagtgctgtgtggagatgaagagggcaacgtgtgggtttncgacgtcaggcacatcctgnccnanncgnctccacggncnagcagctccgcaggcccccacacagattcttnaagtggccccaaccctgggcgctcggccagatggtgaccaagaccatggtgaacacggtggtggccaaccccacctttacctacctcaccgccctgacggactccaatatcgtggccatctggaagagaca

SEQ ID NO: 10649 - DNA, 156 bp, Canis familiaris
cacatgcgatctaaaagaatctataataacttgccggaagttaaaaagaaaaaagaggaacaaaagaagagagtgatcttacagagtaaccgactccgcgctgaggtcttcaaaaagcaattactggaccagctccttcaaaggaacgcggtctaa

SEQ ID NO: 10650 - DNA, 503 bp, Canis familiaris
agttctcctgtgatggtagctcagccagtttatcagcaacctgcatatcactaccaggcccctgcacagtatctaccaggacagtggcagtggggtgttcctcagtctcctgcctctactgctccattcttatacctgcaaccttctgaggttatctatcaaccagtggaaattgcacaagatggtggatgtgtccctcctccactgtctctgatggaagcttcagttccagagccttattctgatcatggagttcaagcaacatatcaccaagtttatgctccaagtgccatcgctatgcctgcacctgtgatgcagcctgaaccaattaaaacagtgtggagcattcattattaagacaattgggcagctctagtccaactcaactgatttcttgtccaatgatccttgtgtggccgagatccagcttccaacgaaccggctagaagctgcccgttgtgacacttagggttagttaatacctcgccatacttatttattcc

SEQ ID NO: 10651 - DNA, 69 bp, Canis familiaris
aggaacgcggtctaaccacaggctgccctgctgacccgctacctggccctgggatgacttcaaacgctg

SEQ ID NO: 10652 - DNA, 293 bp, Canis familiaris
tcatctgatctctacacagcttctctaagatggacgtgtcagagcgcttgctgttgcttctccgtgtaaccacgtcaacaacgtccattctttcatcctgtgatcgtgtgctgagcccctgtggtgtgctggcccaggccccacggactttgaacccaggtcgccctccctccccctggggcgtccttctgatgcccacgatctcctctctgggtcagcccggaacgtgatgaccacaggctgaaccatgtcagggtgcacagcgatatcgcgctccacaacgctaaagtgtg

SEQ ID NO: 10653 - DNA, 527 bp, Canis familiaris
  misc_feature (49)..(49): n is a, c, g, or t
  misc_feature (62)..(62): n is a, c, g, or t
  misc_feature (102)..(102): n is a, c, g, or t
  misc_feature (123)..(123): n is a, c, g, or t
  misc_feature (145)..(145): n is a, c, g, or t
  misc_feature (409)..(409): n is a, c, g, or t
  misc_feature (455)..(455): n is a, c, g, or t
gggacagcaggtgttccgctcttcctacgcccccctgctgagctacatncccttcgtccagnccggctacccgcaccctcagaggacacctccaaagctgtncagccatccccgcgacccttncccgatggcgggagacgggccncagtacgtggtcccccaggcgtacgggttcggctcgacggctggcgggcccctggtgaacagcccctatttttcctctggtgggaatggcataaacttttagacgatcttctctcctccctcctcttaccttagccctcagatcggggctgagggctctggaactccgggttctgtaatcgcgtggccgggggtttggaaaaccaaagttccgaccaggtcacagacagaaaacggcaagaccaggctcatctcttgaccaccntgtgtcacacaccccgcaccccacacacacgcctccctcgcacccngtacccccgccccccacttgaccacatatgcacctgtatttagctgacatgagtgatttttgtttctgttgt

SEQ ID NO: 10654 - DNA, 123 bp, Canis familiaris
cctagtaatagaggagacatttctaaaattgtacccagaactgtctacaccaagagcaaagattcgactgccaatcacactttgacttgcgccaaaatactacctaccagctgtttgtcaaag

SEQ ID NO: 10655 - DNA, 578 bp, Canis familiaris
atgaggcagcataccaaagtttccaagctcagctgctgccctgcgaatcctgtggccgcacattcttgccagatagccttcttattcaccagagaagctgcaagctaaagggtgataggcccagagcaccaaaccccaccagttctgatgatcctgctggtcccaagaaagcttctagtggcatcccagctcgaccaaagactctcatctgctacatttgtggtagggaatttggcactctgtcccttcccattcatgagcccaaatgcctggaaaagtggaaaatagaaaatgaccggctccccagggagcatcgccgaccactcccacagaagccccagccactttcaactggactgtccaaccaagaagggtcaactcaagcacagctggtgccctgtccaaattgctgccggacctttgccccagaccgccttccagtacaccagagaagctgtaaagctcaacctagtgggcaaaaaattcagaatttgactttagggagtaaaggtggcctaaaagagtccactaattccaagcaaccaaggaacatggcagcacccactgtgactgataag

SEQ ID NO: 10656 - DNA, 476 bp, Canis familiaris
aggacacacaactgactctcggcaaactaaatggtcttgtgcaaaagcttgagaaatttctagaacatcagaaaaccaacgaggatgatgactctgcattccctgaatctggtcaggaggaagatttccagttgttcagcagcatccctccaggcatagctcaggtcagtcatcaagaacatgatacttgtcaagacctgcctcacgcctgccaacatgaaggtatcatccagtttccgcagattcccccaagacttcaggaatatgaactttctgagatgataagccagacaactggcagccaaaggacgatcactatagagactgcctcagtctcattgggtcagcaggaggaggaggacactccttccagcacacaggccctctcctgtgtgaattttagaagtgtcttccgctggctaaggcagcaagtcctctcttcacttctcaggagacaacaccctgaggagtccact

SEQ ID NO: 10657 - DNA, 191 bp, Canis familiaris
  misc_feature (34)..(34): n is a, c, g, or t
ggaacgagcgaagagcttccacaattgccggacnccgtggtagagtttcttgcatggggagttctgcagcatccaaaggcaccagaagataaaaactggtatccgagcgccgcggcctgcagcacattctcagcacaaggaacaataacgccctcagtctcatccgcggaacaaaactgcatcgcgctctt

SEQ ID NO: 10658 - DNA, 485 bp, Canis familiaris
gaggacaccaagatctgagtctgtagaaggcttcctgtctccaagtcgttgcggcagtcgaaatggggagaaggactgggaaaatgcatcgacaacctcttcagtagcttctggaacagaatacacaggaccaaagctctacaaagaacccagtgcaaaatccaataagcacataatacagaatgctttagctcattgctgtttggctggaaaagtaaatgaaggtcagaagaaaaaaatactggaggaaatggagaagtcagatgccaacaactttttaatcttgttccgggattcaggctgccaattcaggtctttgtatacttattgcccagaaactgaagaaattaacaaactgacggggataggccctaaatctatcactaaaaaaatgattgagggactttacaaatataattctgaccggaaacagtttagccacatacctgctaaaactttatctgccagtgttgatgcgattacca

SEQ ID NO: 10659 - DNA, 132 bp, Canis familiaris
caagtccagatgcaggtcacagatcatttggaatactttattgatgttgaaattgcccgcagcaattgcagaaagttttcaaacagtagtgaaaactgtgtcattcaagagagctctaaactggaaaagaaa

SEQ ID NO: 10660 - DNA, 367 bp, Canis familiaris
cccttcgccacggatttgattgataatgagactacgccagcgaacccatctggaaaaatgaggccaagcaaagagaggtcctcgcacgcaagcaaagacgtgagtgccttccgagaggagcatctagaagaaaccgtaacacagcacattcagaaactgcacgaacacagaaaaaagttccaggggctggatccactcgaggaagtcagacaggctacgcaggatttagagattgccagaaaactccaggagcaagtgaggaagctgaggctggggcccacctggactaggagccagcagttcacagctcccgccggacgcccgccaccgcacccacctgcgccgcggccttgggacatattgttta

SEQ ID NO: 10661 - DNA, 372 bp, Canis familiaris
cttgcttctgttcaccattttcggggccctggtggccagcacagacctaaacaagaataaagcaaaggtgttgagggaattaaaagtaatcaatgcctcaaatgccaacgtgaagcagtgcctgtggtttgccatgcaagaatacaacaaagagagtgaggataagtacctcttccaagtggtcaagacaatacaagtccagatgcaggtcacagatcatttggaatactttattgatgttgaaattgcccgcagcaattgcagaaagttttcaaacagtagtgaaaactgtgtcattcaagagagctctaaactggaaaagaaagtaatatgcagttttttggtcggagcactcccctggaatggtgaatt

SEQ ID NO: 10662 - DNA, 550 bp, Canis familiaris
gcagaaagcctatgcagtgtttggaaagtgagcagaaattggcgtgaaattattgttcaagataaaaaagcaaatcggaggaggaaattttatatctcacaactgaaaacagattctgagggggctatattaaatgttgaggatgctgccactcggctccatcttataaatcgatcagctttaaaatctgtacaagctcaggctaggataccaggttttcagaaaggagaagtttcaacattttctccttggggagaagttttgacacctatagcaagctcttctgttactcacttaactagtaaacaggaagaatatgttaaggttgccaaaacactatttattgatgaagcattaaaaccttgccccaggtgccaatgccctgctaagtaccagccatttaagaaaaggggactgtgtagccgcacagcctgtggttttgacttttgtgtgttatgtttatgtgcttatcatgggtctgaagaatgtaatagaggagcagcaaagccaagaaatagaaaagatgctcttccaggaagtgcccagagta

SEQ ID NO: 10663 - DNA, 316 bp, Canis familiaris
gcagcgacttttaactgtgtgcagtgaggcccttgcctatttcatcacagtaaattctgagagccatcgggaggcctggacaagtcttctgttgctgcttctaacaaaaaccctcaaaataaatgatgaaaagtttaaagcacacgcttctatgtactacccctacttgtgtgaaattatgcagtttgacctgattcctgagctccgagcagttctgcgcaagttcttcctacggataggtgttgtatataaaatatggattccagaagagccatcacaggtaccagggacgctgtcaccagtgtggtagccctga

SEQ ID NO: 10664 - DNA, 412 bp, Canis familiaris
gaggagctcttcactcactgcatggcctctgagaatggggacacaactaatgggccaccagaatgcgatgaagaactaccgattaccaagcctaacaatgcctatgaatttggtcagattataaatgctattagtatgaggaatgataaagaagcctgtgcacaccttttagccatcactgaaccaaaagatttgccagtgttgttgagtaacaaacttgaaggggatacgttcttcctcctcattcagtctctgaaaaataatcttattggaaaagatccctcactggtgtatcagcatcttttatatctgagtaaagcagaaaggttcatgatgatgttgaccctaattagcaagagccaaaaggaacaaattgaacagctctttgatgatctctcagacacaccaaata

SEQ ID NO: 10665 - DNA, 394 bp, Canis familiaris
gagtcgttctagttcatcagggtccctcaatgctcgaagtggtacagaagatcgatctccagaaaatactggctcatcggtagctgtggataactttccagaagtggacaaggccatgttgattgagaggatagtaaggctgcagaaagcacatgcccggaaaaatgaaaagatagaatttatggaggatcatatcaaacaattggtggaagaaattaggaaaaaaacaaaaataattcagagttatattttacgggaagaatcaggcacactttcttcagaggcatctgattttaacaaagtccatttaagtagacggggtggcattatggcatctttatatacatcccatccagctgatagtggattaacattggacctttctttggagatc

SEQ ID NO: 10666 - DNA, 488 bp, Canis familiaris
tggtcttcgtggaccctcgcaaggacagcgagcgctacgcgcaggagaacttcaagtctttcatcttcacggagacccagttcacggccgtcacagcctatcagaaccaccggatcacccagctgaagatcgccagcaacccttttgccaagggcttcagggagaccgactcggactcctggactgtatcttcccgaaccctgctcagcattccggcccggagtcccagcagcctcagctcctgcctgctgacaggccccgcagagcaggagaaagaccccaacaaagctccggcctctaactccaggacatctgcccggctgcaccatcagctgctgcccccccctgaggctctgctgcctccagccacctaccagcccctcaactaccacggcctgtaccctggagccccaagtcccctcagaatccctaaggcgcgaccagcaccataccccctgcccaatatccaggccggcagagatcaggac

SEQ ID NO: 10667 - DNA, 401 bp, Canis familiaris
gtaggaaccctctgttgctgttggctgtcctggtcctggcagccaggctaggtcattttcaaaggtgggaaggctttcaggagaagtccacgagtgagacaaacatgaattcaacactccaattcttcattgaaaaatacaacaatgctagcaatgacacctacttatttcaagtcgacaagctacttcaaagtcagatgcagctgacgactggagtggagtatatggtaactgtgaagattagccggaccaaatgcaagaggaatagcacaacaaaaaattcatgccccattcaaagcaaaaacaagctgaaaaagagtttcatttgtgactttttgatgtacactgtgccctggatgaactattaccaactctggaataattcttgtctggaggcttga

SEQ ID NO: 10668 - DNA, 195 bp, Canis familiaris
gaaggaatacactcagaagcttgccaaatcttcacagatcatagcagaacttcagacaaccatttcctctctgaaagaggagaacagccggcagcagcttgctgcagaaaggcggctccaggatgttatacagaagtttgaagatgagaagaagcagctgattagagataatgaccgagcaatcaaggctttaca

SEQ ID NO: 10669 - DNA, 503 bp, Canis familiaris
ggagatgtgtgctgtgccaaatacacaaatgatgatttctggtaccgtgccattgttctggggacatcagatgccgaagtgaaagtgctctatgcagattatggaaaccttgaaactctgcctctttccagagtgcagccaatttctatcagccacctggagcttcctttccaaattattaaatgttcacttgaaggactgatggaattgaatggaagctgctctcaattagtaatggaactactaaaaaatttcatgttgaatcagagtgtaatgctttctgtaaaaggaattaccaagaatgtccatacagtgtcagttgagaaattctctggaaatgttactgtcaatctagctgataagctggtgacatatggtctggcaaaaagcatcacatctaaaaaacaaagtactttaaaaaagacatgcaggatgaattgctgttgcacagagttacagaaacaagttgaaaaacatgaacagattcttctcttcctcttaaa

SEQ ID NO: 10670 - DNA, 199 bp, Canis familiaris
aagagcggtgttgatcaggcttcagctggggctgctgcttctggcgctgctcctgccccaggagagctatttacaggctgctaccacgctcgctgctgccaccacagccgctcccaccgggtctgccgtctgcgtcctccagtcgactgtccatgtggtcatggtttccctcttcctccttctacgtcttcactgttga

SEQ ID NO: 10671 - DNA, 103 bp, Canis familiaris
cagcgactacagcaactcatagagatcttgaaggggaagaccttttctagcgcaaaggggtattatgaaatggagaccacagatctcccagaactgaccgctg

SEQ ID NO: 10672 - DNA, 265 bp, Canis familiaris
ggaggcaccttgctgaactcccactggctgctcactgccgctcactgcttcgtctccaaaaagaaagtgtacgactggagactgatttttggcgcaagggagatcgtgtatggaaatgataagcccgcgaagccgccccagcaggaaagatacgtggagaaaatcatcatccacgagagctacgtccccagtctggagtacaacgacatcgcgctcatgaagatcacgccgcccgttccgtgcgggcagttcattggccccggct

SEQ ID NO: 10673 - DNA, 233 bp, Canis familiaris
tgtataacattatctgcctttaggggagagacccaacaaaggtaccaaggacatttaaaattccttctttgatttgtgccaatgatgaacagaggatctatttcacaagccaccgtatcttttttctgtcctaaattgcataccacttggagccataccctgtgcactgatgctaaagaacaaagaaactgtgttttcacacatcaacagtgttgacgtttctgtccagcagc

SEQ ID NO: 10674 - DNA, 505 bp, Canis familiaris
gacccattcgacttggaagctcaggccaaaatagaagaagaaatccggcagcagaacatcgaggaaaatatgaacatagcgatggaggaggctccagagagtttcggacaagtggccatgctctatatcaactgcaaagtgaatggacatcctctgaaggccttcgtggactctggagcccagatgactatcatgagccaagcctgtgccgagagatgtaatataatacggctggtggaccgccggtgggctggcattgccaaaggggtgggcacgcagaggattattggccgagtccatctagctcagattcagattgaaggtgatttcctacagtgctctttctccatcctggaggagcagcccatggacatgcttctggggctggatatgctcaggagacaccagtgttccatcgacttgaagaagaatgtgctggtgatcggcaccactggtacacagactccctttcttcccgagggagagttacccctgtgtgccaagc

SEQ ID NO: 10675 - DNA, 337 bp, Canis familiaris
  misc_feature (49)..(49): n is a, c, g, or t
  misc_feature (139)..(139): n is a, c, g, or t
  misc_feature (250)..(251): n is a, c, g, or t
  misc_feature (255)..(255): n is a, c, g, or t
  misc_feature (264)..(264): n is a, c, g, or t
  misc_feature (274)..(275): n is a, c, g, or t
  misc_feature (278)..(278): n is a, c, g, or t
aaatttactgagatgcctagggcgcattgcacaggactaagtgaagaangttacatcattgaattgacacataccacagggaaaattgtaggcatgttagttacaaatacagttccacactgtaaggcatcttattctnttggatctatagaaatctctttcatacagcaatttacacgaacagcatagtcaatgactacagctttggactttgataaaaattttgtactttaaacttaatgaatagaannaagntgagaattntaaaggttgnnganccatagacctttggtcactagaactttgaattaaaatggagaagtacatgtttcctcaa

SEQ ID NO: 10676 - DNA, 431 bp, Canis familiaris
  misc_feature (34)..(34): n is a, c, g, or t
  misc_feature (55)..(55): n is a, c, g, or t
  misc_feature (85)..(86): n is a, c, g, or t
  misc_feature (96)..(96): n is a, c, g, or t
  misc_feature (98)..(98): n is a, c, g, or t
  misc_feature (109)..(109): n is a, c, g, or t
  misc_feature (111)..(111): n is a, c, g, or t
  misc_feature (114)..(114): n is a, c, g, or t
  misc_feature (125)..(125): n is a, c, g, or t
  misc_feature (129)..(129): n is a, c, g, or t
  misc_feature (348)..(348): n is a, c, g, or t
agtgcctgctcggtgcagaatgcagatgccctcncctctgcgcagtcatggagancatgccggtcctgcagagagaatgaagctnnccaaagagancncagatacaggncnctncaagttaaacnaaanccacagcggcatggagtccttctcattagaaagtcaaacagacatccagaaagctgcaaagcaaattggagagatgccaggacttcagtagaaatcacagatgaggatttcatacttcatgacttttctttaagcaggtacaaaagcagaaagctgaagaactgtctgcgatgagcactaagagtcctgaaatagagtgggactcatagaaggacaagnacaacatagaccacccagaggaggatccagaaggaatacattttattctcagccacactgcctaggcttatcatcagttcttt

SEQ ID NO: 10677 - DNA, 269 bp, Canis familiaris
  misc_feature (201)..(201): n is a, c, g, or t
attctgtttgcttttctgtttgtcttctggaaaagccgctttcagagcagcgttggtgaaatgtcatcaaattcgacttctcttgcactagtaagaccaacctcttctactgggtcaactaagagcaatactgataagagtctttcagtcaacagcctctctcgggaaatcttaattaatttcccacacacgatagccatncagaagcaaatattggtaaacctcaggatcgtggaatacaagctggctgaattggaactttttctagt

SEQ ID NO: 10678 - DNA, 505 bp, Canis familiaris
gaataaatccaatgcacccagtgagaataatctggcgctactttgcagtggttctggtgatcaaacagagtggcatcttggacaagatgacagtgccctccatggcaaacaccttcctccctctccccggaagcgggtttcctccagcggtttgacagattctttgtttatcctgaaagaggaaaacaatgaaaaatacctcagtgttgacaatgtgagggggcctgcagtcacggaaaagccagcttctacttcaggattggatttccagctagctcctcctgaagtttccgaaaatgaaaaaggtaaaacagaaaagaaggaaacactaagccaggtttcagatgatctgctcacacccagccttgggcgacattcatctacttttgttccttgggagaaagaagggaaagaagccaaagagacttcagaagatactggactgcttcatgaagtagtgtcattatgtcacataacgtctgccttccagcaagacttaaccatt

SEQ ID NO: 10679 - DNA, 310 bp, Canis familiaris
aaatgaattgcagattgaacaggaaaatgaaaaacagctgaaggatcaacttcaagaaataagacagaaaataacagaatgtgagagtaaattaaaggactatttggctcagatccagactatggaaagcggtcttgaagcagaaaaattgcaacgggaagttcaggaggcacaagtcaatgaagaagaggttaaaggaaagattggtaaggtcaaaggagaaattgacattcaaggccaacagagtctgaggctggagaatggcattaaagctgtagaaagatctcttggacaagccaccaaacgatta

SEQ ID NO: 10680 - DNA, 463 bp, Canis familiaris
ggactatttggctcagatccagactatggaaagcggtcttgaagcagaaaaattgcaacgggaagttcaggaggcacaagtcaatgaagaagaggttaaaggaaagattggtaaggtcaaaggagaaattgacattcaaggccaacagagtctgaggctggagaatggcattaaagctgtagaaagatctcttggacaagccaccaaacgattacaggacaaagaacaagaactggagcagttgactaaggagctgcggcaagtcaatctccagcagttcatccaacagacagggacaaaagttaccgtgttgccagcagagcccattgaagtagaggcctcacatgcagacatagaaagggaggcaccattccagtccgggtccctgaagcggcctggctcgtcgcggcagctccccagtaatcttcgtattctacagaatcctatctcatctggttttaat

SEQ ID NO: 10681 - DNA, 540 bp, Canis familiaris
  misc_feature (308)..(308): n is a, c, g, or t
aacaatctctttgtatcgcttccttccgaatatcgtaatgcaagccaattgcacagtaacagtgtgggcagctgcatctgaagcaaagcatcagccaccatcagattttctttggagagaacaaaacaagtttaagacaggcccaaattgtacaacgattctgtgcaaacctaatggtgaagctgttgcctggtacactcctattcactggaagcaagcgtgggagaaattagagactgacattgaatttgaaagatgctcgatagtaagtccgtctcaaagacacaggtttccatggccagtatctngaactacaactgaagaaaaacaagataaatctgataaagatatctcaggatatcagatgaaacaagttagagtttttcttaaaagagaaaaagaaaatccaccactcccttttcccaatagcagcccatggtgccacagtcccaatgtccctgcacatccctactgtcctctgattgaaccttgcaataactgcacggctgaaagcagcttagatagacagcctaggcctca

SEQ ID NO: 10682 - DNA, 482 bp, Canis familiaris
tgaaaaggtgtcttcactgggacccctctgcccgtttgaccccagctcaagcattaagacacccttggattagtaagtctgtgcccagacctcttaccattgaaaaggtgtcaggcaaacgggtggtaaatcctgcaaatgctttccagggactgggttccaagctgcctccagttgtcggaatagccaataagctcaaagctaatttaatgtcagaaaccaacggtggtatacctctgtgcagtgtactgccaaaactcattagctaacggacagtgctgtgctcagagatgtatatgtatgtatttttaattatcctgcaaacctgaacatggggagaaaatacaagcccattggtggatatgtttttgttacactagatttcttttttttaacaaggcaaaacatttttatatgactgtaacagaactctccaagggctaattacctaaccagcctgtgttggccatcctggaatgtac

SEQ ID NO: 10683 - DNA, 559 bp, Canis familiaris
  misc_feature (33)..(33): n is a, c, g, or t
  misc_feature (66)..(67): n is a, c, g, or t
  misc_feature (75)..(75): n is a, c, g, or t
  misc_feature (81)..(81): n is a, c, g, or t
  misc_feature (87)..(87): n is a, c, g, or t
  misc_feature (113)..(113): n is a, c, g, or t
  misc_feature (165)..(165): n is a, c, g, or t
  misc_feature (439)..(439): n is a, c, g, or t
  misc_feature (474)..(474): n is a, c, g, or t
aagcctgtgccttcgaagaggaagttgaaggtnaaatggaggagctagcctgcctctttgcagaannttagtccnctgggncctgtngcctcttcaaaaggacagatttatcncaaggccggcaggatcatccggatgccacctgagtgctgtctcccttcccancttcttatgtggcccaccagaaataagaacaggttaaagcatggagaatatgagagcatccctgtagtgtgcaaagtgacaggacaggatggccggttccgaggggaatgtacgacggccatgcaggaggggttggagtccaagagagcctctcataagtcctgggaacgtaactgtcagaggtggaaaaccaaggtaccttacaaagtttcaaacagattcgaggcagatgctgtaaagtttaggaaatagcaggtacagaggaaacagattnctgcgttccagttatatagaagaactaaataagtnatgcatcatcatgatggtttagatttgaattaagaaagcgatcataccaacaaaaagaaaacgtgacattataaagcctttggaa

SEQ ID NO: 10684 - DNA, 483 bp, Canis familiaris
ggatacaccaaaagggtcctgcttatttatgatggcattcactatgatccgcttcagcggaacttccctgacccagacaccccgcctctgaccattttctcctctaatgatgatattgttcttgtacaagcactggaattagcagatgaagccagaagaaagagacagtttactgatgtaaaccgcttcaccctgaggtgcatggtatgtcagaagggattaactggacaagcagaagcaagggaccatgccaaggagacaggccataccaactttggagaagtgtgatctatgcatgatgaggattgccgcctactacctcacagatccagaaggctctgggttttccaataagctatttgtaacccttaaagaacaaaggacacaatgcttgaaccatctttttaacttaaaaccactaagacactgaaattccttgttaagattaaaattagtgtgcaagtttacaggtgtgtgtctaca

SEQ ID NO: 10685 - DNA, 365 bp, Canis familiaris
actgagggcccaggagaccttcatgcagtgggatcagtgccggcgcttctacaacttcctcatggcagacaacatgaagaagatcatcctctcgcacaggcaagctctttttggagaccatgttaagaaaccccagagcctggaggacacagacttgagccgtctctacacagccacgtccctgatgcagatcgatgataacgtgatgaggaagttccatggctacaactccctgaaggaatattacgaggaggaaagctgcatgcgatacctgcacaggatttatgtgcctctcatgctggttaacgcagctgatgatccattggtgcacgagagcctcttaaccattcccaaatctctttcag

SEQ ID NO: 10686 - DNA, 438 bp, Canis familiaris
  misc_feature (67)..(67): n is a, c, g, or t
  misc_feature (114)..(114): n is a, c, g, or t
  misc_feature (145)..(145): n is a, c, g, or t
  misc_feature (270)..(270): n is a, c, g, or t
aatacttagccattcgtgtcctcttagaccatttggggatgaagacatgttgacaattagcaagaancttttcaattatctgcctgattccatcatgttttcttaacatgatancttcaaaaattaacatcctttgtaatttccntagtcttccaaggtataccgctttttacttattttatttacattttaaatatgcccacttagcaattggaacaagttaaattgttcttgattagaagtagtttggaaattttgctcctttgtttnccccccctgtgctgacttgagtcgcccggggccgcgtttgcggaacttggtccctgtccagccttcccgctggaccttttccagagactccctttgaaggcactttgtccagaaatgaaatactgtcacagtggattacttcagcgccctcatttcgtattgtcatta

SEQ ID NO: 10687 - DNA, 506 bp, Canis familiaris
gaagatttctctaccactgaggacactagcaggattttacaagctcatgatagcagtccagaggcagaaaatccaaaatataatcgatgcacaagtaaatctagtgaaacaatactgtccataagaaaaaacagcagtgaaaagagttctgttcttagcccacctttttcagctggatcaccagtacactcatctaaaagatctcatatttcaaagattcaagataaaagtttggaggaaacatcgagtatctctaccagtgatttatctttattacattggactgaggaaaaagaaaatcatatagatcaaaatggtatgcataattctaaagttgtaaagagggatcaggacatgtctataaaacttaaaacaagaactggtggcaagtcttcagaaaaaagccagtcacctcggacatctcaagtgagttcttatctgccatctaatttgtcagaactagaacttaatgttctggatagcagtacatcagatcactttgagga

SEQ ID NO: 10688 - DNA, 456 bp, Canis familiaris
  misc_feature (33)..(33): n is a, c, g, or t
  misc_feature (35)..(35): n is a, c, g, or t
  misc_feature (37)..(39): n is a, c, g, or t
  misc_feature (64)..(64): n is a, c, g, or t
  misc_feature (228)..(228): n is a, c, g, or t
gaagcagtgatgacgaaagcagacaatgacagnangnnncacacagagacactgcagaggctgnctcgcctcctggacctcaagagccaccgcatccgtcagctggaaggtgattttaacctcactgaccctgcggggaaccccaatggatttgttgaggcacaactggactggaagtctttctaccagcccccagagagcttcctgaaaccagaagctcagcctgangagaacagcaccaaggatagtttagagagctcatctaaagaggaccagatggcatttgctgagattcccaccgaagctggccagtatcaagctaagcaaaaacctccacaggtgggagaaagaaaggaaagggaacatcaggttgcaagctactcaagaagaaaacatggcaaaagaacaggcatccaaggaaagagcagaatggaatatcttagtcgtaacatcata

SEQ ID NO: 10689 - DNA, 543 bp, Canis familiaris
aagccacatgctttatgcccgaaaagaaaacctctgaccagtaaggaaaacgtattgacgcactcctccattttggcacccgaaagacagttttggagagccgtgggagatggggagaactggagaaaagacagcctaaggaaagatatggagaaagatttgaaggttgactcaaacatgccactcagcaattctagccaagaggtcacaaaagatctgcttgatatgatcgaccacacaagcatccgaactattgaagagttggctgggaaactagaatttgaaaatgagctgaaccgtgtgtgcagtcgttgcgaagactcgcccttcagggaggaagcctgggccttgctcgtggacgagagccctcagaaggcctcggatactgaccccggcagcctcaagcaggcttttgatgatcacaatattgttgagactgtgctagacttggaagaggactacaatttgatgacctcctctttcaaataccaaattgagtaaggacagttgactggagctttggttctttctagcaggaggctg

SEQ ID NO: 10690 - DNA, 393 bp, Canis familiaris
gaaagacacttgtcctatcctacctaaacttgccaacagctgttctgatgagagttcacataaaccttctaataagtctactgaggttcatttgccacggttttcattaaagcaagggatgatcccacgacattacattatgccttggaaagaaaacatgatattcaggaatatgaatctgaagcatgcagaagtgcgtgggatccatgctggccctttagaagactctctgtttttgaatcacagtgaaaggctttgccacggggaagatcgaaaagttgtcttgaacaaaggcccaccagaaataaaaattgcagatatgcctctgcattcaccgctctccagataccaaagcactgtgatttcccatggcttcaggaggcgactggtcta

SEQ ID NO: 10691 - DNA, 544 bp, Canis familiaris
gcttctatgggcactacagaggtcaattcaagagtgaaagtgctcaagaataccgccttgcagccaagccccagcctccagcagtgttcctgcagcgatgtcaggagccagtgcagcgacacttcttctccaagcatgacaaccgtacgtctttcgacaaagagggcccctactgtctgctgcagggaatcggaaggcggaaggacctagaccgcctgtggcaacggcacaccttcctgcgctgggcaccctgtgagctggagttgagccagcagcggcctcttgaatcctcctaccaggccaatttccagtcaggcccaggagtcagtgacttccctcagcgtcttgtccactttgtgcagatacagcctccccgtaccagcaccacctaccagcagaacttctgccagccatcccggggtggctactgtggcaacaacatggggtcagtcaccgacacactgcctgacctcccagggatcccaagacccaagctgctgcagcattaccttcatgctggggtctctgaatgtctaaactggtc

SEQ ID NO: 10692 - DNA, 446 bp, Canis familiaris
  misc_feature (33)..(33): n is a, c, g, or t
  misc_feature (36)..(37): n is a, c, g, or t
  misc_feature (72)..(72): n is a, c, g, or t
  misc_feature (340)..(340): n is a, c, g, or t
tggatccctgtcaagctcggtcagatgtgctgnccnncaagagccagcagcattcggagaggacactcatgncggctgtgttccgggaaccccatccctgaagagcatcctccaagagagcttttccctttcattttgagcagtgtttccaggtagcttcagcccagaaacttcccagaagcaaacgctccccagtgccccttatctatctctatgtgcatctcagaggaggaagagacaagaagggaggccagagatcgtctttgtggagacggttggacagtgcttcctatggcaagacaatgccatgatcaatcctaaatggtgacagaaaccaacntcagccaagaatggccgggatgagtcagctctggaccatttagcgaacgtgtcctagttgggtgggaagactgaggcctctgtctgccctttctcaggacaatgaa

SEQ ID NO: 10693 - DNA, 370 bp, Canis familiaris
  misc_feature (41)..(41): n is a, c, g, or t
  misc_feature (48)..(48): n is a, c, g, or t
  misc_feature (56)..(56): n is a, c, g, or t
  misc_feature (308)..(308): n is a, c, g, or t
  misc_feature (310)..(310): n is a, c, g, or t
gaatcctatcctggctgtctgaggagaatggggagaaaatngggggcncacagtgngcagctaagagttttgcaggcaaacctgccctcaaaacgttgcataaggtccctaagtacccacccagctagagaaaggatggtggtttgcagccttatgtgggaagaagccaagaaagatgacaagcagaaccaagttcacacccctgttgatgagagcacaactcttggaacatggagcctggaacagggctccggaacaggggcaccctgggaaagtggctccatgcccagaactgtcccatccagagnanctgcacaagcagtgacctggtcacctactcatccaggagccttattttcctaaactcatg

SEQ ID NO: 10694 - DNA, 407 bp, Canis familiaris
  misc_feature (66)..(66): n is a, c, g, or t
  misc_feature (70)..(70): n is a, c, g, or t
tgaccgtggatcagcgagcctccatcattcagaggtttcgggatgggaaagagaaagttcttatancaanccaatgtctgtgctcgagggatcgatgtgaagcaggtcacgattgttgtgaactttgacctccctgtaaaccaagcagaggagccagactacgagacctaccttcaccgcatagggcggacaggacgctttgggaaaaagggcctggccttcaacatgattgaagtggataagctgcccctgctcatgaagatccaggatcacttcaacagcagtattaagcaactcgaccctgaagacatggatgaaattgaaaatattgaatattgaatattgaagacagaactttattgcttgtgaaatatcctagtttatgtgagactgtcccagtgggtttc

SEQ ID NO: 10695 - DNA, 545 bp, Canis familiaris
agcagattgggccttacgatggatagaagatagaaaatctacttttggggaaagagtcgtggcttttgctgctgtagaagggattttcttctctggatcttttgctgctatattctggctaaagaaaagaggtctcatgcctggactcactttttccaatgaactcatcagcagagatgaagggcttcactgtgactttgcttgcctgatgtttcaatacttagtaaataaaccttcagaagaaagggtcagggagatcattgttaatgctgttgaaattgagcaggagtttttaacggaagccttgccagttggcctcattggaatgaattgtgttttgatgaaacagtatattgagtttgtagctgacagattacttgtggaacttggattctcaaaggttttccaggcagaaaatccctttgattttatggaaaacatttctttagaagggaaaactaatttctttgagaaacgagttgcagagtatcaacgttttgcggttatggcagaaactacagataatgtcttcaccttggatgcag

SEQ ID NO: 10696 - DNA, 539 bp, Canis familiaris
  misc_feature (88)..(88): n is a, c, g, or t
aggagatcgcccgtctgagggccatgcaggagaaggcccaggactaccaggcggagcaggatgccttgcgggccaagcgcaaccaggnggttgcagacagggagtggcgcagaaaggaaaaggaaaacgcgcagaagaaggtggagacagaggccaagctgcgcaaaagccggctggagcaggtggctctcaaggagcatgctctggccgttcaggtgcaacgggaccgggatgagttcgagaggattcttcgggcgcagagagagcagattgagaaggagcggctggaggaggagaggaaggccaccgggcgcctgcggcacgccaacgagctgcggcgccaggtgcgtgagaaccagcagaagcaggtgcaggaccgcatcgccaccttcgaggagggccggcgcctccaagaggaggcccagaagcggcgtgagcgcatcgatgacatcaagaagaaaaagatcgaagagctcagagccaccggccttcccgagaagtactgcatcgaggctgagcgcaaagccaacatcctgcca

SEQ ID NO: 10697 - DNA, 539 bp, Canis familiaris
agcctccacaagtcaggtttgcaatcctgggaagacattgacaaactaaattcattccccaaacttgaagaagtgagattgttaggaattcctcttctgcagccatataccactgaggaacggaggaaattggtaatagccagattgccatcagtttccaaacttaatggcagtgttgttaccgatggtgaacgagaagattctgagagattttttatccgttactatgtggatgttccacaagaagaagtgccattcaggtatcatgaactgattacaaaatatgggaagttggagcctttggcagaagtggacctcagaccccagagcagtgcgaaagtagaagtccactttaacgaccaggtggaagaaatgagcattcgtctggaccaaacagttgcagaactaaagaaacaattaaaaactctagtgcagttacccacaagcaacatgcttctctactattttgaccatgaagcaccctttggcccagaggaaatgaagtacagctctcgggcactgcattcttttggcattag

SEQ ID NO: 10698 - DNA, 576 bp, Canis familiaris
ggttcaagcaagtggcccaggcctacgaggtgctgtcggacgcccggaagagggacgtgtacgaccggtacggcgaggcgggagtggagggcggcggcggcagcgggccctgccacgaccccttcgagtacgtcttcaccttccgcgacccggccgaggtcttcagggagttcttcgggggccaagacccgttttctgccttcgacttcttcggagacccgctggagagcgtcgtgggcgggcggaggagctcccggggcggcggcggcggcagggggaccgtccccttcttctccgccttcagtgaatttccagcattcgggggaggtttttcctctttggatacgggattcagttccctggggaacggaggcctgtcttccttctccatgtcctacggtagcggcgggacgggcaacttcaaatccgtgtcgacttccaccgaaatcgttaatggcaagaagatcaccaccaagagaaccgtcgagaatggccaagaacgggtggaggtggaggaagacggagagttgaagtccctggtgataaatggcaaagagcagttgctgcgccttgaca

SEQ ID NO: 10699 - DNA, 390 bp, Canis familiaris
gccaagacaaacactttctgcggaacccctgactacattgccccagagatcttgctgggtcagaaatataaccattctgttgactggtggtcatttggagttctcctctatgagatgctaattggtcagtcacccttccatgggcaagatgaagaagagcttttccactccatccgcatggacaatcccttttaccctcgatggcttgagaaggaggcgaaggaccttttagtgaagctgttcgtgagggaacctgaaaagaggctgggagtgaggggagacatccgccagcatcctttgtttcgggagatcaactgggaagagcttgaaagaaaggagattgacccaccattccggcctaaagtgaaatcaccgtatgactgcagcaat

SEQ ID NO: 10700 - DNA, 386 bp, Canis familiaris
gatgttggactgcatgatttcttaatcaggtatgtgtacattccggtaggcgggtcccagcatggcctgctggggacactgttttccaccgctgtgacgtttgcatttgtgagcttctggcatggtggctatgactacctctggtgctgggcagcactcaactggctgggagtcaccgtggagaatgtagtccagaggcttgtgcgaaccccgtgcatccaggacagcgtgattcagttcctctccccacaagcccgccgtcgattccacgctgccctcgcatcttgttccacctccatgctgatcttgtccaacctggtgtttctcgggggcagtcaagttgggaaaatctactggaacaggatcttcatacaaggctggccata

SEQ ID NO: 10701 - DNA, 554 bp, Canis familiaris
ggcaacaaatgccagcgatgcacgaattcagagaagaagtatggaccaccatattcatgtgaacagtgtaaacaacagtgtgcatttgacaggaaagatgatagaaagaaggtagatgggaaattgctgtgttggctgtgcacactttcatacaaacgggtccttcaaaagaccaaagagcagaggaaacatctgagcagctcttcccgtgccagccaccaggagaaggaacagtatcgactgagtggtggcagccattataacagcttttccccagacctggctctggactcaccaggcactgaccactttgtcatcattgcccagctgaaggaagaagtggccactttgaagaagatgctgcatcaaaaggatcaaatgattttagagaaagagaagaagatcacagagttgaaggctgattttcaataccaagaatctcagatgagagccaaaatgaaccagatggagaaaactcacaaagaagtcacagagcaattgcaggccaaaaaccgagaactcctgaagcaggcagctgccttgtccaagagcaa

SEQ ID NO: 10702 - DNA, 497 bp, Canis familiaris
gggatctcttcgttgggcagctaaagagctccctgacttgtactgactgtggttactgctctactgtctttgatcccttctgggacctctcattgcccatcgctaagcgaggttatcccgaggtaactttaacggactgcatgaggctcttcaccaaagaggatgtgcttgatggtgatgaaaagccaacatgctgtcgctgccgagccagaaaacgatgtataaagaagttctccatccagaggttcccaaagatcttggtgctccatctgaagcggttctcagaatccagaatacgaaccagcaagctcacaacatttgtgaatttcccactaagagacctggacctgagagaatttgcctcagaaaacaccaaccacgctgtttacaacctgtacgctgtgtccaatcactctggaaccaccatgggcggccattacacagcctactgccggagtccagtgacaggcgaatggcacactttcaatgactccagc

SEQ ID NO: 10703 - DNA, 348 bp, Canis familiaris
gtgatgattttgacgttgaaactaaaatggaagagcagaaaagaaaccttggatcttctgaacttggagaaccaagtttagtttgtgaggaagatgaaattatgaggtctaaagaaagtctagatctttcaatttctcattctcaggttgaacagttagtcagtaaaacatctgaacttgatgtatctgaaagcaaaacaagaagtggaaaaatctttcagaataaaatggctaatggaaatcaaccagtaaaatcttctaaagaaaatcggaagagaaatcaactcgaatctgggaaaacagtcctttatcactttgattcttctagtcaagagtcagtgcccaaaa

SEQ ID NO: 10704 - DNA, 574 bp, Canis familiaris
  misc_feature (96)..(96): n is a, c, g, or t
tgtgctactcgaagcgagcgcgctcctgcggcctgtgtgatctctacccgtgctgcctgtgcgacgtcaagctctactgtctgcgaccatctctcngaagtttggagaggaaagccattagagccatagaagatgaaaagagagagcttgccaaactgagaagaacaacaaatagaattctggcctcctcttgctgtagcagtaacattttaggatcagtaaacgtgtgcggctttgagcctgatcaagtcaaagtccgggtgaaggacggcaaggtgtgcgtgtcggccgagcgggagaacagatacgactgcctcgggtcgaaaaagtacagctacatgaacatctgcaaagagttcagcctgccgccgtgcgtggacgagaaagacgtgacttactcctatgggctggggagttgcgtcaagattgagtctccatgctacccctgcacgtctccctgcaacccctgcaacccctgcagtccttgtagcccctgcagcccctgtaacccctgcaacccctgtgacccttgcagcccatgctatccctgcgggagccgattttcctgtagaaa

SEQ ID NO: 10705 - DNA, 156 bp, Canis familiaris
agtgacctggatctgacctcacaccatctacggggaccacccaccaggcatacccatgctggagtaggctgctgtccctgggagctccaggctatttttgtgcttagttactggtttttgccattgcattgttatccacggtgacaagtgacagga

SEQ ID NO: 10706 - DNA, 162 bp, Canis familiaris
gcgagagggctatgacccgagacaacaacctgctggggcgtttcgacctgactggaatccctcctgcacccaggggagtgccccagattgaggtgacctttgacattgatgccaatggtattctcaatgtaacagccatggacaagtccacgggcaaggcca

SEQ ID NO: 10707 - DNA, 354 bp, Canis familiaris
gatcctgggcagtaggtgtaccacaccccagagccttctcagtgtgacaccaaaaccttccggtcagccacagaacacacacagaagacagacacgacagaactgttcctgctattgccaccgccgctgccactgctacggccgtgggcatttagaaaacttgaaagtcagcactaaaagatgggcagaggttcaacccacacctcctccactttgcttctgaaagcccattattagaccacttgtaatgattattccaacccagttgtcacatctttggttcaaaatggcatgtctctccaacaatttaagtgcctgatacaaagtccaaagtgtaatcatcttcctttcctc

SEQ ID NO: 10708 - DNA, 507 bp, Canis familiaris
  misc_feature (96)..(96): n is a, c, g, or t
  misc_feature (132)..(132): n is a, c, g, or t
  misc_feature (309)..(309): n is a, c, g, or t
gaagcggtattacttggttcctgaccgggagttgaagcacatagagaggcacatacaccgcgtggggcaggtcagagagctcaagaacaaagcagnccggcacctaccacggcctagtgaaacaaagttccngaggatcctgccagaagagcgtggtgtcctgggcacacagaggaggaagcaggtaagcgagcgggagcagatacagatcaaagatcaccagcagcgcatgctccagggaagagaggtcctggagcagaggctccaggaaggagtcctgagacaaggccggagccagaggcccacacntgaccggtgtgcaagagccgagaaagaaaccaaagagtttgaaagtgttaccgtataccctctcttccaaccatgcagtcagagtcggattaaagtgaacattctcatggaaaagaatagagaggaagccattaccattataaaaccacatcaaagaaaattcttaacgatgccgccctttctgcgaagccaaatagg

SEQ ID NO: 10709 - DNA, 167 bp, Canis familiaris
gaaggacccaggctatcgattcgaactcctgtgctttgatgtcagagcttgtgaaaccaatggtggacgtaaagatgcagaggaagctccaattttatgtaaaacaaaggttccagatcacagaaggtcatcacaagcaaaagttattaaaatgatcagtaatgtcc

SEQ ID NO: 10710 - DNA, 355 bp, Canis familiaris
tgaagcaattcaccaaggccgccattcgcacccagccgcaggacctcatccagtgggctgcggattatttcggggctatgtcccgtggagagattcctccagtgagagagcggtctgagcgagtggctttgtctaactgggcagagcttacacctgagctgttaaagatcctgcattctcgggttgctggcagactgatcatccatgcagatgagctggcccagatgtggaaggtgctgagtctcccaacagatctgtttaatagtgtgatgaacgtgggccgcttcacggaggagattgaatggctgaagtttttagctcttgcttgcagttctctgggagttaccattgccaa

SEQ ID NO: 10711 - DNA, 216 bp, Canis familiaris
aaaactcacaacgtctgtgcttccgcctcagtgcatgagattcatgaatcagcattacgagccaagaacagaagacaggtggaaaaaaggaaactggtcacccagaggcagcgtgctcactccgtggaggtggagaagaacagacgggtgaagccttccgcctccgagaacccgtggatgacagaatatatgaggtgctattcagcacgagcataa

SEQ ID NO: 10712 - DNA, 274 bp, Canis familiaris
  misc_feature (47)..(47): n is a, c, g, or t
  misc_feature (103)..(104): n is a, c, g, or t
  misc_feature (107)..(107): n is a, c, g, or t
  misc_feature (109)..(110): n is a, c, g, or t
  misc_feature (154)..(154): n is a, c, g, or t
ccatcctgaaagtgccttgtggcctctacccttcgaagttggaactnttcctaatacccacaggaagatcaaggccaaaggcaagttcaaggccagactctannacnannccaaggctgaggcatgcctcatgaagacactgagccttccaggncccctgccctttatcaatgcataccaggagctagggggcatgggggatgtgaggctggagaagtccttgcttcaggcctcactgcccctatcctggatgcagcgccaaataaaaaggagc

SEQ ID NO: 10713 - DNA, 259 bp, Canis familiaris
aaaatatgccaagttccctgaatcacagtctttaaaatacaaaattgtggaagctcagaaaaactcaaaaccatccctcttcccagaagtattaaagacagaaaatctaaagcccaaggtccgaaaagaaagagaccgtgtcaacaaacaaaagaagtcatttagcaagatactaccaaccacactgcccaccacaagaattctaaggaaatctgttccaagaacattgcttcactggactgcaagaagaactatacat

SEQ ID NO: 10714 - DNA, 74 bp, Canis familiaris
gaacagatgatggaagtcggacgaaatgatcttctacgtcgctcagtaaagcaccaaggaaaagatgacactga

SEQ ID NO: 10715 - DNA, 571 bp, Canis familiaris
  misc_feature (444)..(444): n is a, c, g, or t
caagtatgcgcctatttttgaaagcgactttatccagattaccaagaggggagaagtcatcgacgtgcacaaccgggtgagaatggtgacggtgggcatcgcatccaccagcccgatcctgccgctcccggacgtcatgctgctggcccggccggccgcgggctgcgaggagcacgggcgcggccaggccgccaagggcaaaggccgcaaggctgcaaaggccttggagctcaccaggctccttcccctgaagttcgtgaggatctccattcacgaccgtgagaaacagcagctgcgcctcaagttcgccacgggccgctcgtgctacctgcagctgagcccgcctctgcacgggcgggaagacctcttcgcccactgggaaaagctcatctacctcctgcggccaccggtggacagtaacagcagcacctacgccatcccggnaggggacatgctgtgcatgcccgagtttgaggaagaggacgggaggagcgcggcaggggccgatttccaagggaaaggggatcaggaccaggtcagcatccggagcctccacgtggtctccgaggtg

SEQ ID NO: 10716 - DNA, 315 bp, Canis familiaris
  misc_feature (163)..(163): n is a, c, g, or t
atgacttctacaaacaggaccagtgaaagaattgaaaagcttaaagcaagcagacaacgtctcctggaggaaataaatgaaaagcgtgaatccaactgctttgtggaaagaagcaatcaagttagctcactgagagttcaaaagaggcatttcagcaccgccngtcagtcctctactcacactcaaattaaagaatctgttcctgacagtggcaggagctcctggattaaacggagtctccttgctcacccagagaaaactttcctgcaaaaaataatgccatatttggataaagtgcatctccagagacacaca

SEQ ID NO: 10717 - DNA, 540 bp, Canis familiaris
  misc_feature (215)..(215): n is a, c, g, or t
gtgcagttatccacaagccgacttcggactgcccctgggatgggagaccagagtggctgctatcggtgtgggaaagaggggcactggtcaaaagagtgtccagtagatcgtacaggtcgtgtggcggactttaccgagcagtataacgaacagtatggagcagtgcgcacgccttacaccatgggctacggggaatccatgtattacaacgatgngtatggagcactcgactactataagcgttaccgggtccgctcttatgaggcagtggcagcggcagcagcagcttctgcgtacaactacgcggagcagtccatgtcccatctgcctcaagtccagagcacagctgtgaccagtcacctcaactccacttctgttgatccctacgacagacacctcaacacttcctcctattatggaagggacaggagccccctgcgtcgtgctgcagctgtgctccccacagttggagagggctacggttatgggccagagagtgagctgtctcaggcttcagcagctgcacggaattctctatat

SEQ ID NO: 10718 - DNA, 407 bp, Canis familiaris
aagaacaattgctggctatcatgaaagcagatcagattttccaggagcatgaaaaggagaaaaaacgcaaagctgataaaaaacatcgagaagttcgagatgcccatattcagcaaatggccaaaaataaatttaatgcaaagcaagaaaaacaagcagaattagagtattacagacttgctgaagcacttgtggctgaaaaggagaaggaattccaagattatgccagagaagtaattgaacttgagtctgaatcaacaaataaatatatttatcctcttgtaaaagctgtacaggaaggacacggaggtggccgtggaccagtttttgtggacagaggtggattaagacccagttaccaggcaaatgataccactggagtccagcttcctttttataactctcag

SEQ ID NO: 10719 - DNA, 582 bp, Canis familiaris
aagaggaccagcctcctgggagaaccttacaaaatcctgaacctgcagaagcgtctggagcacctgtggtccatgcttgaggtccctgacaaggaccggctagacatggtcatcaagtacagctccaatgcccgtctgagtcagctgccttcattagtgagtgcctgggagcaagtcctgaagcccattcagctgagggaaatgttgctggggagactagaattgtttgagcgacaagcttctgaccccaaccgcttcttccaaaagactaacatgggcctgggtagcttcctggaggagaatcagttccgcaaccgtctacacaggaagatcaatctggtgcaggctcctttggtttccctcctgaaggaaattgaattaatctttggtgagccagtgaccttcaaggggcggcgatacctggataagatgaagcatgacaaggtggagatgctgtactggctacagcagcagcaacgggtccaccacctgacacagggtcagaaggcctcccaccagccagggctgttcaagaagctcagcatccagccttcaataactcctgggaatactcctattact

SEQ ID NO: 10720 - DNA, 168 bp, Canis familiaris
  misc_feature (90)..(94): n is a, c, g, or t
  misc_feature (96)..(96): n is a, c, g, or t
  misc_feature (98)..(99): n is a, c, g, or t
  misc_feature (101)..(102): n is a, c, g, or t
  misc_feature (104)..(104): n is a, c, g, or t
ctgaagtggtggtctttgaccctcaagcttcccactgaatctgatggaccctccttgatgacctgaataaaatgacagaaccaaagtaannnnnanannannanttaggctttattcttttttgtacagactacattctataagaaatacctacttgataatttgaat

SEQ ID NO: 10721 - DNA, 541 bp, Canis familiaris
attgtggacacgcagaactctgacaatgaggaagacgatcagtttgtggtggaagctgcccccccgctccctgagatgtcagaacttgaaatggtgcccgcggtggacgtagaggacgaggagaagcacggaggacttgtgaaaaaaattctggagaccaagaaagattatgagaagttacagcggtcacccagacctggagagaaggagaaattgcttgtctttgagtcagcatggaagaaggagaaggacatagtttccaaggagatagagaagctgcgtgtgtccatccagaccctgtgcaagagtgcgctccccctggggaagatcatggactacatccaggaggacgtggacgccatgcagaacgagctgcagctgtggcacaacgagaataagcagcacgccgaggccctgcagaaggagcagagcatcacggactgcgcggtggagcccttgaaggccgagctggctgagctggagcagctgattaaggaccagcaggacaagatctgcgccgtgaaggccaacgtcctgaaga

SEQ ID NO: 10722 - DNA, 497 bp, Canis familiaris
  misc_feature (421)..(421): n is a, c, g, or t
taagtggcatcacacctctactctacgtagctcagacaagacaatctaatatcttaaaaatactcctgcaatatggaatcttagaaagagaaaaaaatcccatcaacattgtgataacaatattgctctacccttcaagagtgagaataatggttgatcatgaattggtagacatccaggaagatgccaaaacatgtttagtgctgtgttccagagtgctttctgccatttcaatcagggaaatagagacgcagctaagtttaggaagacgtccaattatttctaattggctggactacattccttcaacaagatacaaagatccatgtgaactatcacatctttgcagaataaccattagggctcaactactgaccaacaatatgctcccaaatggaatattttcacttcaaataccggntcgtctacagaagtacctgaatttagaaagttaataaacatctttctcctgagttctttaaggatactcaccattg

SEQ ID NO: 10723 - DNA, 481 bp, Canis familiaris
gagccacaatggattttgacagcagtagtgcaagctttgaaagtgggacaaacagtgaagatattaagaaagccagtattctactgatccgtaaattatatatactgatgcagaaccttggaccccttcctaatgatgttatacttactatgaaactccactactataatgcagtgactccacatgattaccaaccccctggttttaaagaaggggtaaactcacacctcctgctgttcgagggggagcctgttaacctgcaagtgggattggtctccactggttttcatagcatgaaagtaaaagtcacaactgaggtcaccagagtgtctgatttggagaacaatctctttcaggagaacagcactactgagattgctcatcagggtctagacttcgatgaggaagaagaggaatgcaacaatcacattcaaagaatgaattttgcgtacagtcagcaaagttctgagagctccaggaa

SEQ ID NO: 10724 - DNA, 327 bp, Canis familiaris
agacagttacttggaaggtgaaagcgaaagtcagcaaggtaccactgatggcttcgagcagcctgagtcagtagaatttagtagtggagagaaagaggatgatgatgaagtggaaactgaccaaaacttgtggtatagcagaaaatttatcgaacaaggacacaaggaagagaccgaacacatactgtccaaattcatggcaaaatatgattttaagtgtgaccacttgtcagagattccagaggagcaggaaggagcagaggattcagaaggaagtggaatagaggagcaagaggtagaggcaaatgagaatgtggaggtgcctgc

SEQ ID NO: 10725 - DNA, 453 bp, Canis familiaris
  misc_feature (371)..(371): n is a, c, g, or t
gaactttgggcagctttccaacctcaaggtccatctgcgtgtgcacagtggggagcgcccattccaatgtgccctgtgccagaagagcttcactcagctcgcccacctgcagaagcaccacttggtgcatactggggagcggccctatgagtgcctggtgagaccctccttcccctcccctgtactcctgcaggctgctgacaccagtgcccattcccaccagatgtgccacaaacgcttcagcaactccagcaacctcaagacccacctgcgcctgcactcgggggcccgggccttccagtgcagtgtttgtccacgtcgcttcacccagcacgttcacctgaagctgcatcatcacctgcatgtcgcanggccttgtggccacctgtccctggcatctcttgcctgctttgcccgatggcaccaggaagcactggatcttgtggcactgcc

SEQ ID NO: 10726 - DNA, 281 bp, Canis familiaris
ggaagaatttttgtgcaagctcatttcttcagggctgtcaaccttcatattgaaatctccaaggacctgaaagaaagcttggaagtagttaaccaagctcaactggctttaaattttgcaaggcttgtggaagagcaagagaatatatttcaagctgcagtcttagaagaattacaggagttatcgaacgaagccctgagaaaaattctacgaagagatcttccagtgacccgcactcttattgactggcaaaggatactctctgacttgaatctggtgat

SEQ ID NO: 10727 - DNA, 540 bp, Canis familiaris
tgtgcgcctgcacggcattatcaaaggcaaaaatctggaggagttaaggcacattaatttcttcccggagtcctggttgatccgggttacagccaaccattaccacgcactggagagtgggggtgacatggttcacgtgaaagatcttaccacccaggctatgagatttggactgctctttaaccaggagtatacaactcattcagaaatcattgccgtatatggattcttctttgagataaagggaatcaaacaggatactacctcttatagtttttacatgcagagagtaaggcacactgatttggagttcccgtcctcggtctgtaagcatggcccggttagcctgagagcggagcgcttggtgaagtacgagatcagagcccagaccctggtggacggcaagtggcaggagttcaggaccaatcagatcacccagaagttcgggtttgtcaagccatcctgtaaaagccacgccttgaaaatccaaactgtgggcatcccaatctatgtaagtttttcattcatcttcccaatatc

SEQ ID NO: 10728 - DNA, 532 bp, Canis familiaris
caaatggtggccttaaatttccagacccccggtctacccatggatcttcaaaatgggaaatttttggataatggtagttctggatatattttgaaaccacagttcctaagagatagtaaaacaccgtttagtccaaataaaacaccaagatacagtaatccagtgacacttacaataaggctcatcagtggtattcagttacctcccagtaaccattcatcatctaacaaagctgacacattagtgattctagaaacttttggtgttccaaatgatcaaatgaagcagcagactcgtgtaattaaaaaaaatgcttttagtccaaaatggaatgaaacattcacatttattattcatgtgccagaattggcgctgatgcgttttgttgttgaaaatcaaggtttaatagccggaaatgaatttcttggtcaatatacattaccagttctgtgcatgaacaaaggttaccgtcgtgttcctctgttttctaaaatgggcgagagtcttgagcctgctgcactgtttatttatg

SEQ ID NO: 10729 - DNA, 123 bp, Canis familiaris
gaataaatgtaatgctctctgtcttagcaggataatggcccaaacctgacatggacaagcattctttggaaagttcaagaagcaatacaatgtaacatgtcactcgtgctttaaaattaattg

SEQ ID NO: 10730 - DNA, 116 bp, Canis familiaris
aattcaaagcagattgctccagcaaaagcagacctggagtctgaatcttttcgaccaaacctaagtgatcccagtgaactcttactgccagatcaaattgaaaagcttaccaagca

SEQ ID NO: 10731 - DNA, 43 bp, Canis familiaris
gccctcagaggagttcagaatgccacaacgtgagaagctcacc

SEQ ID NO: 10732 - DNA, 509 bp, Canis familiaris
aatggccgaaatttctcctgtgaggcctctttggaggttcagggtcaacggttaatcaaaactactacaatgcagctccatgtcttataccagcctcggttagaggaatctgattgccctggcaaccagacgtgggtgaaagggacagagcagatgcttgcctgcatcccaaagggaaacccaactccaaccttggtatgtacctggaatggagtgatcttcaaccttgacgagccacagaaggcaacccagaaccacacggggatctactgctgcacagccactaaccagctgggctctgtcagcaaagacattgctgtccttgttcaaggactggatgaaggaatcagctccaccatctttgtcatcattatcgttgcccttggagtgggtattatcaccatagcactgtatctgaactacaagccttgcaaaatagagaggcggaaattgccctataggcagaaagagaagaacaaagaggaggaaagccagtttgctgttcagca

SEQ ID NO: 10733 - DNA, 355 bp, Canis familiaris
gggcagttttcaggacctacttacaatcctacggccaagaatctcaatattgtgaaccgtgcacagccagttccctcagtgcatgggaggacagactgggtggccaagtacggcggccaccggtaggagtccggcagccaccaataggagtctgatgtgaagccccacagcattgctccatagagtccatgcaagtcccctgtccctgggaaatgtctacagatgtctatttccaatgagttctagaagaaaaatgtagtgggtacttggaaaagcaaaaaccatctattttctttctttcctagaaatgaaatgcattttcttagcatcagttgcccacagtgctgatatatgg

SEQ ID NO: 10734 - DNA, 421 bp, Canis familiaris
ggtgtgaaccgacacttccacatgatctgtatccgggacaagttcagccagaacattggtcggcaggtcccatccaaggtcatctgggaccatctgagcaccatgtatgacatgcaggcactgcatgaatctgagatccttccatttccaaatccagagaggaatttcgtccttccggaagaaatcattcacgaagtccgagaaggaaaagtggtcattgaagaggaaatgaaggaggaaatgaaggaagacgtggacccccacaacggggcggacgatgttttttcgtcttcaggaagcttggggaaagcaaccgagaagtccagcaaagacaagagcccgtcagacttggggtccaaggagggggcggacaagcggaagcgcagccgggtcaccgacaaagtcctcacggcaaacagca

SEQ ID NO: 10735 - DNA, 567 bp, Canis familiaris
gataccttagtctgtgctgggaagaataaagcctcattctcttgttccctcgctcagaacttggaacattctcacttgctggaccaaaaggaaggagagaaagacccttcctggaaaagggaatggcttcatggatctaataaaaagaactatcaggatgtgcagagacatgttcaaccacctgggggcaagggccttcagctattggacaagaccaaattagaaaaggtgtctgccaaagaaaccacccaaacccccatcctctttcaaaactacagggattcctggaatggagaagacacagattctgggaaacaaagcccttatcccgtctctgtgttttcctgggacagtgaaaagaatgacaaggactcctggagtcagcttttcactgaggattctcagggccagcgggtcattgcccacaagtctagagctcctttccgagatataactaacaaccaggatcggggcttagggcagtttcttaacagctcttgggctcagtgccaggagaagcccactcagttaaatctccagcctgatttgctctttacccaggactct

SEQ ID NO: 10736 - DNA, 473 bp, Canis familiaris
  misc_feature (54)..(54): n is a, c, g, or t
  misc_feature (376)..(376): n is a, c, g, or t
gatcggactaacacaaaagacaccagaatccagcacaagtgcagtgttaaaagngccccaccgtccgcatttgtctcggcaagtagaggagaggctgccacccatctacaaagttcgggagaagcaagcggtcaataacaacttccccttctctgtacacgacaatcggcatagctttcagagttctggatgctaccttgactctggcctgggacgtaggaagatctccccagagaaaaggcaacatgtttcaagaaatttcaatctctgggcaggtgactatgttccatcttgtcttgatggtttttcaaataaccaaatatcatatgtctatcaagaagttgtggtggtcccaatttttagacgcttcccaagntgttataatgagaaatggaactcttttaaatttattcctcagagaagctacacagaatttttgaaaaagaaaccaaaagtaaggtttgctattgaca

SEQ ID NO: 10737 - DNA, 287 bp, Canis familiaris
gaacctccaccttatgttgttcctgtgtcacctaagcttcccaaaacaaagatgcatgcctctacagaagaactactgtctatagagggaaatggcatgcccaaagaggaaaagcttcctgaagattccaagaactcaccactaaatccaggaagttctttaagccccagcagcagaaatcccataagtacctctactaccatcactaggaatttttctcaaagtgtgccaggcacctcaagttcaccactagtggggaccaaatctaccaagagcagtcaccatga

SEQ ID NO: 10738 - DNA, 344 bp, Canis familiaris
gaagtgataactgcctcctttgatggggaaactcactcagtccagctccctccagtgaatagtgcctcatttgctctgcgttttcttgagaccttgtgtcatagcttgcagtgtgataaccttttgagtagccagccttttagctcttacagacgtaatactcctagtcctgcagagcacgataaaaataatcctgggtccttgctggggtgcttgatagaaggttccaggaatgagaccatttctccctacctaacatctcttctttcaaatgatcaggtcaagtatgatttgtcttttttcccccccattgaagctccaagttatatagctgtacccgaccc

SEQ ID NO: 10739 - DNA, 256 bp, Canis familiaris
atgaaggcatctgtggttctctccctcattggctacctagtggttccaagtggtgctgctatcttggggcgctgcgtggtagctaagaagctctatgatggaggcctgaattattttgagggctacagccttgaaaactgggtgtgcctggcttattttgagagcaagttcaaccccatggccatctacgagaacttgcctggtggctacactggctacggcctctttcagattcgcgactgggactggtgcgaca

SEQ ID NO: 10740 - DNA, 73 bp, Canis familiaris
ccctccgggagaagatgctgccttgttataaaaggcatcacttataaggaacgggaggacttgacactccggc

SEQ ID NO: 10741 - DNA, 531 bp, Canis familiaris
actgtattttctgcttctaattattatgaagaaggcagcaatcgaggagcttacatcaaactgtgcagtggtatgaaccttcgatttttccagtaccaagtaactaaggcaacgtgcttgaggcctctttaccaaaggtgtgtatgctctaagaattctgagcgctggtactggtggccaagtagaaccagaaaacttccgatgggccagtgggctttttccatggagaacgttttgggactgaacttaccatggagatccctgagtccacatctggtaaccacagacaaaagtggaaatatcaactacatgtccagcttcgaggatatccacattcagaaacctgctcaatcgactctaattgaaactctgtacagataccgatctgacctgcaaatcatctttaacatcattgactctgatcactcaggcctgatttccatggaagaatttcgtgccatgtggaaactcttcaatagtcactacagcattcatattgatgactttcaaattgatgacctcgccgaaaga

SEQ ID NO: 10742 - DNA, 453 bp, Canis familiaris
ctctgtatctggctaacacagttgaagaagatgaagaagaatccaaatatgaaatttttccatgggctttagggaaaaactggagaaaattgttccctaatttcttaaagttaagggaccaactctgggatagaattgactatagggctattgtaagcaggcgatgctgtgaggaggttatggctattgctccaactcattatatatggcaacgggaacgctctgtgcatcacagtggagctgttagaaactacaacagagatgaagttcaactgccccggggacctagtgccacaccagtagattgttcactctgtggtaaaaaaggaagatatgttagactgggattatcttcatcatcttcatccagtgatacagtagaggtgatggagaaacattctcaggaatcacataactccatggacatagtagttgatcgttctcaagcttata

SEQ ID NO: 10743 - DNA, 299 bp, Canis familiaris
tggcctgcaccacagagtctgacaagacctggtacctggtaggcattatcagctggggcaagagctgtggacggaagaacacaccagggatatacactttgttagaaaattacaccctttggatcaagaaggtgactgagatggagggaagaccttttaatgctgaggaaatgagaggttctcccaataggaaacaaatgaggtcccatgcagcagaatttccagagccaggaagccgcagattctggcttctgatttcacttctgccctacatgttactctgggccattttctactga

SEQ ID NO: 10744 - DNA, 592 bp, Canis familiaris
  misc_feature (270)..(270): n is a, c, g, or t
actcagatccagtccataactgtgaaagaagatgataatgccaaggatgtctttgaacaaatgttcaaaatttttaaagagatgcaatctgtagtggagacaaagtatgaccaaatgcaaaaggaacctttatattccaagattgcaacagctgtttgctctgtggttgagaataccaccaatgtaaaggagttgcagcagtcagctaaagaagtgttcaaaactgttcaaacaccagtcattctctctgcattgaatagtagtaacatncttaggattttggaatcttctctttcactcttgatgaaatatcccgtcatgaatcttcagttaggtgacctctatagaaaagacaccaaagagcaatcagatgccaacacatccaagaaaaacacaagtccgggtccatccaaaattggtacaatagacatcttgaaaaaattgcaggatgcgctagaaactgaggattccaagaataccatcaagtcaattgcagttcagttggaggaggttgtcaaaacaatagcgcctatcttagaagtcctccaaaaagccataaatactatggaaaccaaggtttctgtgcccaaga

SEQ ID NO: 10745 - DNA, 430 bp, Canis familiaris
agagacccaagcttcattatgaccaatgtgagagaatgcatcccttcccacaacaaaattaagagtcctcccttgagccatggaaaccaatgggcaccatttactgattgacttacacctggaaatttggaccagtgactatggaaagaaggatggatttatcctgattgcctgtggcccagttctttgctggagctggggccattttgctctaacccatatagtagcaaagaatggatactgggaagataatcacaatataatgctgcctgtctctaaactgatgtttatgctgcttctctggaattaaatgtggactcttcctttctttctgcttattgaaatacttctcatcttgtaaggataagataaggacttatttttcttctacaggctaccctctttgactgtctcatcaatactttttcct

SEQ ID NO: 10746 - DNA, 145 bp, Canis familiaris
agctctccaagcaactgctgtcagtctagcaacttctctgagccttcagagagtcaacagcaaagcctcctgaaatccagaatccctttatccgggtttctttgccccttacaagatttatgcacacctccacaggaagacagtg

SEQ ID NO: 10747 - DNA, 340 bp, Canis familiaris
gtgggtgcactatatcaggtatgacacaaataattggaagtaatacagttgagacagaaaatgaagagtcttgcctaccgatcagtaaagatatttccaaaagaaaaaaacaggaatctttatctgaagcagccagggatccatgcgtttctgcaaaaagaagaaaaaagttccccaaagcttcctcagaccaagaggaaacagaaatcaactttacccaaaaactgatagatttggaacgcttactttttgagagacataaacaagaagaacaggacaggttattagcgttacagcttcagaaagaagtagataaagaacaaatgaagccaaaccggca

SEQ ID NO: 10748 - DNA, 507 bp, Canis familiaris
tgatttccaggaggtcgtgcgagcctttgaactgaaggggcactctgcagccgtccacttcttcgctttctccaatgattcccgcaggatggcctcagtctccaaggatggtacgtggaaactgtgggacacagatgtggaatacaagaagcaacaggatccctacttgctgaggacaggctgctttgaagaggcgagcaccatgctctgccgcctggccctctcccctgacgcccaggtcttggctttggccagtggcagcagtattcatctctacaacacccggcggggtgagaaggaagagtgctttgagcaggtccatggggagtgtatcactgacttgtcctttgacatcactggccggcttctggcctcctgtggggaccgggcagtgcggcttttccacaacacccccggccaccgggcagtggtggaggaaatgcagggcctcctgaagcgagcctccaacgagagcacccgccaaaggctacagcagcagctgaccca

SEQ ID NO: 10749 - DNA, 136 bp, Canis familiaris
aggcgtggctgtgtgaattcccaagtgggcagccccctggcccccaagcccaagccttcatcaactgtggaatcctctggaacttagaggcctgacatcagcaacttggtcagaagtcctcaaaggacaagccaca

SEQ ID NO: 10750 - DNA, 313 bp, Canis familiaris
gagcatccccgtcgtgtttaaagatgtcatcaggcctggcatgcggcgaaaagttcctggagaaggcctccccctccccaaaacacccgagaaacgcggggacctcattattgagtttgaagtaatcttccccgaaaggattccccagacgtcaagaaccgtacttgagcaggttcttccaatatagagccacctgtgtctcccaaggactaaccagggacctttccagagctcaaggatttccggaccgttccaccagttgtggacccgtgagagggcgggagggcccagggagggctttcgtactgctgaa

SEQ ID NO: 10751 - DNA, 483 bp, Canis familiaris
  misc_feature (412)..(412): n is a, c, g, or t
tctcctctccagactgcattttgggggactcccagaagggagagcagctgaggcggaactgcaccatctaccggccctggttctccccttacagctacttcgtctgcacggaccaggagagccacctggaggcctatagcttcgcagaggtgcagcgggacgagggcaggggcgacagctgcagccccgaggacctggctgagagcatctgctcgtcctcttcctccccagagaacacctgcccccgagaggtcagccccaaatccaggcacagcctggtccccgccgaccacatcacgtcccaggacatcctcacggcctccaagtggcacccggcccagcagagtggctacaagtgcgtggcctgctgccgcatgtaccccactctgcactccctcaagagccacataanggggggcttcagggagggcttcagctgcaaggtgtactactgcaagctcaaaaccctctggcaaggagcag

SEQ ID NO: 10752 - DNA, 325 bp, Canis familiaris
gggcgggagtttaggctgcgccgacccctcagcccccctccaggagacgttcggagccctggacatgtcgggattgaggagatacgaggtggcgctggaggcggaggaggagatctactggggttgcttctactttttcccctggctgcgcatgtggcggagggaccggagctcggcgcatccccgggagcagaagctggagcctctgcgaggcctgatgagctgtctgtcaagcggcctgggccctgccccccagcgctcgggtcgcggcctcccccgccgcacccccaccgccactgcccagccagccggtgcattaaagatt

SEQ ID NO: 10753 - DNA, 179 bp, Canis familiaris
  misc_feature (140)..(140): n is a, c, g, or t
accaggtagtgtgcatgaggccgtaaataccctggcagaagaacagacatacactggtcagccctactcttcccagtgttgttcttctagtccatcatgcggtctgaacagttttctgaattgaattttcaatatgcaangtacaattccttttgcggtccttgtacctcatttgtaaa

SEQ ID NO: 10754 - DNA, 534 bp, Canis familiaris
gcttgtatgtctatgggcttcttgattgaagagactgcaccagttgtttggagaggccttatggtaatgtcagccattgagaaactgttgaggcaggtagattggggtccacttgactatttagttgttgacacgccaccaggaactggagatgtacagttatccatctcacagaatattcccatttcaggtgctgtgatcgtctctacgccccaggacattgcattggtggacgcacataagggtgctgagatgtttcggaaagtccatgtgcctgttttgggccttatccaaaatatgagtgttttccagtgtccaaaatgtaaacacagaactcatatttttggtgctgatggtgcaagaagactagcacagacccttgatcttgatattctaggagacattcccttacatcttaatataagggaaacttcagatacaggccagccgattgtgttttcacagcctgaaagtgatgaggccaaagcttacctgaggattgctgcagaagtagtaagaagattgccgccacct

SEQ ID NO: 10755 - DNA, 469 bp, Canis familiaris
  misc_feature (413)..(413): n is a, c, g, or t
aacataccttttactttctttgcagtctctgatttcccaaatcaaagtgataatggaaacagaatggcagtctctgctttcaaggatgaaaaggaagccattaagataaaggcagaccctgagaaactcaagaaattacaagaaagtctcctgcaggaggactcggaggaggaggatggagacttgtgtcgcatctgtcagatagccgggggttccccaaccaaccccctcctggagccctgtggctgtgtgggcagcctacggttcgttcatcaggagtgcctgaaaaagtggctgaaagtgaaaataacatcaggagcagatctaggtgctgtgaaaacttgtgagatgtgtaagcaaggcctgctggttgacctggatgattttaacgtgaccgacttctatcagaagcntcagcaatcccgggcacaaaatgagctgatgaattcaggtttgtacctggtgctgc

SEQ ID NO: 10756 - DNA, 340 bp, Canis familiaris
cagaagactggaggccacatgcttggaattatggctgggccttctacgtggcctgggtttccttcacctgctgcatggcatcagcagtcaccaccttcaacacatacaccaagctggtgctggagttcaagtgtaagcacagtaagagcttcaaaggaaagctgagcttcccgccgcaccaccaccagtgttcccttcagcatctgtcatgcgcggcccacacggggggtactttgaccagctaccaccagtaccacaatcagcccatccgctctgtctctgaaggagttgacttctactcagagctacaccgcaagggattccaacaaggacttagccg

SEQ ID NO: 10757 - DNA, 276 bp, Canis familiaris
aaaggactactggagtttgccacgttgcaaggcccatgtcaccccactctccgatttggagggaagcagttgatggagaaggctttcctcccccaccctcccttggggcttgtggcaaagatcctatggttatcactgggagcccagttcttctccatcggacttgaattcgtcagcttcctcctgctgctaatggacctgctgttcactgggaacccgggctacgggctcaagctgagtgccttcgcggcaatttcctctgtcttgtcaggcctt

SEQ ID NO: 10758 - DNA, 367 bp, Canis familiaris
gtgccttcagcagcatctatgtcatcctttggttgttacttggttccattatctttcgaaatattatagtagccatgatggttactaacttccagaatatcaggaatgagctgaatgaggagatgacacatctggaggttcagcataaagccgacatattcaagcggcagattatccagaggtctctgccccattttcaaacccaagtttacaataaaatttctcctttcacttatagaaatgccaatcaacaaagggaatctgtggacttatcaaaagcttttgaagaagagtctaaacacaatgctgatgaagagggttcaagagcacctgtgtcaaaaacaaaagcgtccttgtctagacatgt

SEQ ID NO: 10759 - DNA, 414 bp, Canis familiaris
tggtcacatgactctcgaaaactgtatattaaaatgtgaaggaacaggagtgtgtgttcttacaggggctgctttgacaattacagacagtgaaataactggtgcccagggtgctggtgttgaactgtatcctgggagcatagctgttttagaaaggaatgaaattcatcattgtaataacctcagaaccagtgacaattcaaaaagcaccttaggtggagttaatatgaaggttcttccagcaccaaaattgaagatgactaataatcatatttacaacaacaatggctatggtgtaagcattcttcaaccaactgaacaattttttatcgtagcagaagaagccctcaacaaaggggcagcttcaggggataaaaaagaggacagtatgctctccagggtaatgcagaatct

SEQ ID NO: 10760 - DNA, 574 bp, Canis familiaris
aggaccactaaagcataccactgatgtgatctatgcagctaaaatgatatcagaatcaggatcaaggatggatgtccttgctcggcagattgcaaaccagtgcccagatccatcatgcaagcaagatttgttggcctatctggaacagattaagttttactctcaccaactgaagatctgcagtcaagttaaagctgagatacagaacctaggaggagaactcatcatgtcagccgtgagtttttctgtaacattaaatctttttatatttctgattgcattcatgaataatagctctttttccctcctacagttggatagcgtcacctccctgattcaagcagccaaaaatttaatgaatgctgtggtgcaaacagtgaaaatgtcttacattgcctcaaccaagatcatccgaattcagagtcctgctgggccccggcacccagttgtgatgtggagaatgaaggctcctgcaaaaaaacccttgattaaaagagagaagccagaggaaacttgtgcagctgtcagacgaggctcagcaaagaaaaaaatccacccagtgcaagttatgagt

SEQ ID NO: 10761 - DNA, 271 bp, Canis familiaris
  misc_feature (84)..(84): n is a, c, g, or t
cgaaccatgttcagggccgcggcgccgcccccaggccgcccggcactgcgtgagggccagcctaggttcagccgcttcctccanttcatggatgagttctgccaggagcccacggctagtgactcgaaaggctaagggctgcgcacagggccatgcacactgcctgtgccctctgccctttgcaggctccgagccccggaccgcaccttggggttgggtggccaggtacaggcctcagaccttggcttggccttgcttgctggctgcagag

SEQ ID NO: 10762 - DNA, 537 bp, Canis familiaris
  misc_feature (396)..(396): n is a, c, g, or t
  misc_feature (400)..(400): n is a, c, g, or t
  misc_feature (402)..(402): n is a, c, g, or t
  misc_feature (405)..(410): n is a, c, g, or t
  misc_feature (412)..(412): n is a, c, g, or t
aggtcttctaaatcacactagctttttcaaataaaaaccattttttgatattgccaaaataatgacaggaaacctcctcattaaactgttaaacttttttatggctaggtgaaaatatgaattgtttcccaaaaatatgctgagttgtattgtaccttttaggcaaagcaaagcaaggctgtgtaaattaaagctttgtgagtagtactttccactggggcatcagtcttgctgggctgaatccgcttctttgttggttcagtatttcttatgaagaactgcagtatagagcttgaagttatttaaaatactaaatcattttactttgtgtttccattttattaacgggatgttgcaatcctttttaaactaataaacttgtaaagtgattggcanaaananaannnnnnancaaaaagttgcacagcgaagcacaaaaagatatctaatttggagactcttaaaatgtttgctatagtcataaccatggcttttacattgaaagactaataggaattctggcatgttcattctttt

SEQ ID NO: 10763 - DNA, 224 bp, Canis familiaris
agcgaatagagcagcatatgcaacctcacggatgaagcgtcccaggagattcgcagcagaaattcctacgcagactgctgagagctacaggtgagagggcgccagggttggggaacagcctgtgtcacagaacgtctatgacccttgacgggaggagcaaccacacctgggcagaggggaccccgcggtgagcccttgcttgtgacgggcccactggaaccttc

SEQ ID NO: 10764 - DNA, 394 bp, Canis familiaris
aagggagttttgtccatcacttcctccagaaccagggcctgttgtccccgcctagaggcgccggtgctaagaaagacggagaagatcagataatagccaaaatcgttgagctgctgaaatattcaggggatcggttggaaagagagttgaagaaagacaaggctttaatgaacagcttccaggaccggctgtcctaccctgttttcaagaccatcacagaccagttcttaaggggtgttgacaccaggggagaatcagaggtcagagctcggggctttaaggctgctcttgcaatagacgtcacggccaagctcactgccattgacaaccaccccatgaacagggtgctgggatttggaaccaagtacctgaaagacaacttctcaccctgggt

SEQ ID NO: 10765 - DNA, 530 bp, Canis familiaris
atcccagcttactaccatatgtgttatcaatgcttccagtgccacctgcagtgggcccgactttcagctttgaattggatgtggaagatggagaagtagaaaattatgaggccctgttaaacctggcagagcgactgggagaggctaaaccccgaggactgactaaagcagatattgaacagcttccttcttatcggttcaatcctaacaaccaccagtcagaacagactttgtgtgtagtatgcatgtgtgattttgagtcaaggcagctacttagagttttaccctgtaaccacgagttccatgccaagtgtgtcgacaaatggcttaaggcaaatcgtacttgcccaatctgccgagctgatgcttccgaagtgcatcgggattcagaatgaccaacctaagagcacaaatttagtttgggtgttcctcatcacatgtatatacggactcttcattgaacttaatctgtgtggcttccagccctccctttaccaaaagggtcaatggacctttctttgcactgtgtg

SEQ ID NO: 10766 - DNA, 50 bp, Canis familiaris
aagaaggaacagaagcctctccacctgcgctgcatgaagtggtcaccgag

SEQ ID NO: 10767 - DNA, 583 bp, Canis familiaris
aaaggatccttggttcctgtacgagcctaatgcaagccattcaggtcctgattgtggcctctaaggatctccagagagaaatagtggagagtggccggggcacagcatcacctaaagagttttatgccaagaattctcgatggacagaaggactcatctcagcctccaaagccgttggctggggagccactatcatggtggatgcagctgatctggtggtgcaaggcagagggaaatttgaggaactaatggtgtgttcgcatgaaattgctgctagcacagcccagcttgtggctgcatctaaggtaaaagctgataaggacagcccaaacctggcccagctgcagcaggcctcccggggggtgaaccaggccaccgccacagttgtggcctccaccatttcgggcaaatcacagattgaggagacagataatatggatttctccagcatgacactgacccagatcaaacgccaagagatggattcccaggtccgggtgctagagctggagaatgacctgcagaaggaacgtcagaaactgggagagcttcgaaaaaagcactacgagctcgctggtgttgc

SEQ ID NO: 10768 - DNA, 408 bp, Canis familiaris
  misc_feature (166)..(166): n is a, c, g, or t
  misc_feature (232)..(232): n is a, c, g, or t
  misc_feature (383)..(383): n is a, c, g, or t
gcagcacacggctacggaaagatttggaagatgaagggctcgtgtggatttcacttccatttccttccacttcctgcacttcccagaaaacgaaaaggagaacgatatgtacagttgacagcagaggatttggaggcctgtccctctctaaagaaactgtgtcttntggacagaaaccgagtatgccattccctgtatcaggtaaagaaaacagagagggctttgctgctgnttcttccagtttacctggaaagaggaggaagagtgtctgcacatctgtgctcgcaaatacaagagatactactactcaggcaaaatgctacaaaagaagaacctctctcagccagaagggagagagctctccgaaggacttccaaagaatngaacctgtccaggaactaaagcagt

SEQ ID NO: 10769 - DNA, 107 bp, Canis familiaris
  misc_feature (72)..(72): n is a, c, g, or t
gaactaaagcagtagctggcatttcctacagaacgcagggcagcagagaaggtaaccatccgtgctcaaaanattcattcattccagttcatgtcccttgttcagct

SEQ ID NO: 10770 - DNA, 397 bp, Canis familiaris
  misc_feature (230)..(230): n is a, c, g, or t
gaatacattgcttttcgatgtgcctactgttttttcttgaatcctgcaagaaaaactagacctcaggctccaaggcttccagagtttagttttgagaagagacaggcagtggaaagctcaagttcacttggtcccttgccctcaggaagtgtgatttcatcagagaaccagatcactgaagaatctgtagaagaacaagatgttcttgataacagtacagagcagacagncgagaaaatatcagacacagagcagacaaaccaagggactgaaaaagtatctggcacagaggaaccagaggagaagcaagaggctgagaatgaggacacctcaatgaatgaagccaaatcagtagtccccagagccgatcctattcctaatcctgaactcagtggag

SEQ ID NO: 10771 - DNA, 249 bp, Canis familiaris
ttggtcagcttcctcattgccataaatcaggccagcctcatcaatcgctgcgacttggccagggtgctgcgcaaggaggacttggatgggtttgagggctactccttgaatgactggctatgtctggcttttgtggaaagcagattcaacatatcaaaggtaaatgaaaacgcagacggcagcttcgactatggcatcttccagatcaacagccattactggtgcaacgattaccggagtcactcagaa

SEQ ID NO: 10772 - DNA, 574 bp, Canis familiaris
acaacatcgtcgctgtggcactgggcgtggaaggccaagccaaagctgtgctggccagaaaactgagaacaaccccctcgtgcatcaaaaatgtgatcatctggggtaatattagtggaaataactacattgatctgagaaaagccaaggtttacagatatgagagtgctatttggggacctcctaactattcacgtcctgttttgagcttgatttttgatagtgagtgggtaaacagacaatatgtggcaactcttagaaagctgaccgccacaggaaaacaattcagacccatcttagctgcgcacagtatagctactacattgaaatactggtaccatggctcaccaccgggggagatcgtgtctttaggagtactaagtgaaggccagtttggtattcctgaagggatcgtcttttctatgcctgtaaaatttgagaatggaacttggatagttcttacagatctcacagatattgaaatcagtgagcaaataatgaccagaatgacaagtgatctaattcaggaaaaacttattgcacttggagatttggtcagttttcagccctatca

SEQ ID NO: 10773 - DNA, 442 bp, Canis familiaris
  misc_feature (97)..(97): n is a, c, g, or t
  misc_feature (114)..(114): n is a, c, g, or t
  misc_feature (129)..(129): n is a, c, g, or t
  misc_feature (131)..(131): n is a, c, g, or t
  misc_feature (153)..(153): n is a, c, g, or t
gttgaacctgaacacttctcttgtgaaacatatcaagaatttgctatgcctaaagcatcctgccatcaaaggatccaagaaatgcctgcccctgagnaatatacacctgaaatntatcaagagacaccngnacctgcggactcttcacctganatataccaagaaacagctgggactgaagactcttcacctgaaatataccaagaaacacctgggcctgaggacctctctactaagacatataaaaataaggatatgcctaaagaatgctttccagaaccataccaagaaacaggtgggccccaaggccaggatcctaaaacacatcaggaggatgctaaggatgtttatacttttccccgagaaatgagagaaaaacccaaagcagaagaaccagagataccagcaattccaaatgttcctcaagagattcatccagaaa

SEQ ID NO: 10774 - DNA, 568 bp, Canis familiaris
aacactgtttcccaacagctacttgttggttggagtttgcagtgatgaccttacccacaaattcaaaggtttcaccgtgatgaacgaagcagagagatatgaagctctcagacactgtcgctatgtggatgaagtcattagagatgctccatggacactcactccagaatttctggaaaaacacaagattgactttgtggcgcatgatgacattccctactcttctgcgggctctgatgatgtttacaagcatataaaggaagcaggaatgtttgttccaacgcagagaacggaaggcatctcaacatcagacatcatcaccagaatcgtccgtgactatgatgtctatgcccgacgcaacctccagagagggtacacggccaaggaactaaatgtcagctttataaatgagaagaagtaccgtttccaaaaccaggtagacaagatgaaggaaaaggtcaagaatgtggaggaaagatcaaaggaatttgttaacagagtggaagaaaagagtcatgatctaattcaaaagtgggaagagaagtcgagggaattcattggcaacttc

SEQ ID NO: 10775 - DNA, 102 bp, Canis familiaris
tatgttacagaggtgaatcagtgcttgaagcctaagggcacaaaaatgaagataagcctgtcccaagtctgatctcagcagattcctgagctttattaaaaa

SEQ ID NO: 10776 - DNA, 182 bp, Canis familiaris
  misc_feature (82)..(82): n is a, c, g, or t
gtcaagaccagagacgagtccttgagttgcctgaagacatgaaggcttttttgctgactttggctgcgctggtgcttttgtnccaggtcacttcaggcagtgctgaaaaatgctggaatcttcgtggctcctgccgtgagaaatgcatcaagaatgaaaagctttacattttctgcacgagt

SEQ ID NO: 10777 - DNA, 47 bp, Canis familiaris
tccgcgtattcaagggattgaacaaattaccttcggtgagtggcatg

SEQ ID NO: 10778 - DNA, 433 bp, Canis familiaris
  misc_feature (256)..(256): n is a, c, g, or t
aaagtgtgtgtatgcgaccctcagcaattcaacagactgcacatcttcagagaagtctttgaagacatttgcaatagttctttgatatttggtgatatcttgaaagaaattaaggatgaatatgaactctacatggcgatacttctgcagtccacatccccatcacagtataagactttgctagctaatgccaaggggctggagaggaggtccgtgaagacagcagatgtcaaccaggccagggaggagctgaggntgattgtgacagccaccaaagaagccctggagcataatgacaaactcagaagtgaactagagatggagcacacattgttgcaatctgctaaggaaaatagtattttgcttttaaaaatatttctagaatcatataagaaagatgtaatggatgaggattgccttactcttattgaga

SEQ ID NO: 10779 - DNA, 43 bp, Canis familiaris
ttttgatgagagatcacatccactcacacgagaaaaggttccg

SEQ ID NO: 10780 - DNA, 494 bp, Canis familiaris
ttcgtactcttttcagtgctgcacagctaacagctgaatgtgcaatagtaactttggtttacttagaaaggcttttaacttatgctgagatcgacatttgtcccactaactggaaaagaattgtcttgggagccattcttcttgcctccaaggtttgggacgatcaggctgtatggaatgtggactactgccaaatcctgaaggacattacagttgaggacatgaatgagatggaaaggcattttttggagctacttcagtttaatattaatgttccctccagtgtttatgccaaatactactttgaccttcgctccttagcagatgacaacaacgtgaattttctgtttgctcctcttagcaaagaaagagcacaaaacctagaggccatttccagattgtgtgaagacaaatacaaagactggtctcgagctgctatgagaaggtctttcagcgctgataatttcattggtattcagcgctctaatgccatc

SEQ ID NO: 10781 - DNA, 433 bp, Canis familiaris
  misc_feature (201)..(201): n is a, c, g, or t
cacgtcctgttcatgcaggaaaacaaatacaaagaagccatcggtttctatgagcccatagtcaagaagcattatgacaacatcttgaacgtcagtgctatcgtgctggctaacctgtgtgtttcgtacattatgacaagtcagaatgaagaagctgaggagttgatgagaaagattgaggaggaagagcagctgtcctangatgaccccgataagaaaatctaccatctctgcattgtgaatttggtgatagggacactctattgtgccaaaggaaattatgactttggtatttctcgggttatcaaaagcctggaaccttatcataagaaactgggaactgacacctggtattatgccaaaagatgcttcctgtccttattagaaaacatgtcaaaacatacgatcatgctccgtgacagtgttattcaag

SEQ ID NO: 10782 - DNA, 212 bp, Canis familiaris
gagaggactgtaggagactcaactcaggaaagaatgaagaacagtttgaggcattggggacctctcaagctgagtgcctgagtcactctgccccaattaggagaatagtagactctgttaggagcagatgtatccagctcctgccagagaagaaacagggtccttccgaaagcctcttcagaaaaagagtaaggcgcttttttcagtggatt

SEQ ID NO: 10783 - DNA, 144 bp, Canis familiaris
tcctgagtcaactagcactttccaggagtcttgcagagcctcatctaccaccattattacttctgatatttctggtacaagatctgatgaaggtgagaacagtcaagatgaggaaaatctctatttctctgagcccttaccttc

SEQ ID NO: 10784 - DNA, 304 bp, Canis familiaris
atggaggtccaggaggcaagctcttccaacaaggacttggggggcaagaaggaaggaaaatacatcaaactcacagtcgttggacaagacaacagtgaggttcacttcaaactgaaaatgacgacccatctgaagaaactcaaagagttgtactgtcaaagggtgggtgttaccatcaatacgctcaggtttctctttgatgggcagagaatcgctgataatcacaccccaaaagaactgaacatggaggaagatgatgtgatccgagtctaccaggaacaagtagaggatcacgcaaggattt

SEQ ID NO: 10785 - DNA, 511 bp, Canis familiaris
aagactggcctgttgatgactattctgggtgtgatcttcacaaagggcaactgtgccgctgaggagcaagtctggcaagtattgaatgtgattgggttatatgcggggatggagcacttcatttttggggagcccaggaagctcatcaccgaggatttggtgaaagaagagtacctggagtacaggcaggtggccaacagtgatcctccacgctatgagttcctgtggggccccagagcctatgccgaaaccagcaagatgaaagtcctggagtttttagccaaggttcattataccgtccctagtgccttcccagcctggtatgaagaagctttgcaagatgaggaagaaagagcacaagctagagctgcagccagggctcacactgcagccatggccagtgcacgtgccagggccatgaccagtgcacattctaagggcataaccaatgagcactccagggccatgaccaatgtgcattccagggccatagccagtgtgcgctccaagg

SEQ ID NO: 10786 - DNA, 580 bp, Canis familiaris
  misc_feature (300)..(300): n is a, c, g, or t
tgctggtcactttcgtcgccatggtcctcatgcagatgggccagcccgccctactgtacctggtgtccagcaccctgctcaccagcctggctgtggccgcctgccgccaagagctcaccctcttctggaccggccaggccagagccaagacgcccgcccagcccgtggcggggctccatgacgccccttcatttggctctgagcagaagcaggaggagacggcagacgtccacacagccggcaagtttgagggggccaccggccacctggcaggggacttggacagcaacctggaagagnccgaggccgaggccaccaccgcatctgaggatgaggccagtggtctggatgtccacagtgatagctccgagggctggagagatgccaacctggaccccgacgagctgcctcaggcctcccccgggtcctcggaggagctcgtgccgctgatgccaccgccctcagtgctgggccaagcccgggcccaggcccaggcccaggcccatgacactggcctgccctggatggggctccacaagaggaagggcgggaaggtgcagaggagcatgtcaacccacgc

SEQ ID NO: 10787 - DNA, 279 bp, Canis familiaris
tggcggcctgcctgttggaggatcccactgaggcgctgagtaaccgcgtggtgcccttcctgaagcagaagctcctcagcaccaatgatgacattcgcagcaaagctgcctgcatgctcactgtggtcagcatccctctggagggcaagaaccaggtgtggcagcatgatgtcatccccatcctggtgcacctgctgaaggacaagatggaggaggtgcaggccaatgctgccggggccctcatgtatgccacgatgaccacccaagggaaatatgctg

SEQ ID NO: 10788 - DNA, 542 bp, Canis familiaris
aggacattgcccttctgaagctcagggcccccatatcctggtccccgctcatccagcctgtctgcctacccagcagcagatttgagccatctatcggaaccttgtgctgggtgatcgggtggggatataaaaatcctcaagtaaccccaaagagcccctacagtcttcaggaggtggctgtcaagatcataaacagtgaaatctgccgtcagcagtaccagttcctcttcttgaaggaccagaagcagttcattgggaatgacatgctgtgtgtcagctcagaatggggcatggactcctgtcaggacaactctggcagctccctcgtgtgccaggtgaacaactcttggattcagataggggtggtgagctggagccttagctgcaaccggcaccgcctcccaagcatctataccagcacctcccagttcacccactggatcaagaggcagatcagcgacatgaggttcatcagtaggggtgatcctgccttcctgagcccggtcgcccgcactggttacattctgctggtgtccttgggc

SEQ ID NO: 10789 - DNA, 93 bp, Canis familiaris
acattttataaggactccagttacagaaaagcagatgtacttccctcttcagaattatccagtaaacaacatggtaacaggttatatatcaat

SEQ ID NO: 10790 - DNA, 168 bp, Canis familiaris
gctgaagaagactttaggagtccaaatcccgaacatttgggaatgaaccaagctggaaaaatcaaatgcgaagtttctggcttcttcagggaacaaccgttccgtagttggctcttccattagagtgtggatcccttaccattgactgctgagttcatctccaattaa

SEQ ID NO: 10791 - DNA, 348 bp, Canis familiaris
  misc_feature (296)..(296): n is a, c, g, or t
tgatcaacagagatgcagacttcaggaggcttgcaaagatattctccttttcaaaaatcttgatcaggaacaactttctcaagtccttgatgccatgtttgaaagaacagtcaaagttgatgagcatgtcattgaccaaggagacgatggagacaacttttatgtcattgaacggggaacctatgatattttagtaacaaaagataatcaaactcgctctgttggtcagtatgacaaccgtggcagttttggagaacttgctctgatgtacaacaccccaagagctgctaccattntcgccacttcagaaggctccctttggggactggaccgcgtgacttttagaag

SEQ ID NO: 10792 - DNA, 531 bp, Canis familiaris
aaggacaccacgtgctccaagaagcagctccagacccccagtgcccagccagctccgccagccacagactcccaacagctaccaaacccctacccatcctcctccagtctctcaccagccatcggtctggaagagctggtcaactttgcctcttccttggctgtggcctcttccagcaagatggacttgcccaacttggagcacatgatcaaagctccaccccagaaggccgaggcgccttctacagatcccaccacccaggtggccgtggaccagcccgagaagaaaaagcttactaaggagttgccagatagaccaccacttaaagccagggagtcacagaaagctcagaagccacaagacaagaacttctcccacccttacctcgacttcagcaagccggggatcaagagggccaccattaaaggagaagtgaagcttctccagccaccggccatgtcccctctgcctcaaggagacatgaaagactcggtgccgggaaccaggaaagggagtccattattgctgaaa

SEQ ID NO: 10793 - DNA, 459 bp, Canis familiaris
  misc_feature (64)..(64): n is a, c, g, or t
  misc_feature (67)..(67): n is a, c, g, or t
  misc_feature (432)..(432): n is a, c, g, or t
tcgacagccggatcagcctggagctgtccgcctcctacgtctaccagtccatggccttctcctncgnccgcgacgacggggccctgaggaacttggcccgcttcttccagcgccaggcccgcgaggagacccagcacgccgagatgctcgtggagctgcagaaccggcgcgggggccgcatccgtctgcgcgacgtcaagaagcccgaccgcgacgcctgggagagcggcccgagggccacggagcgcgccctgcacctggagaagcgcgtgaaccagagcctgcctgctcgacctgacctgcaccggctggccaccgaccagaacgacgcccagctctgcgacttcctggaggcccgctccctccgccatccaagagctctgggaggctacggcaccagcctgcgcagcgtgggggccccggaagccggcncggccgagtacccgttcgacaggctca

SEQ ID NO: 10794 - DNA, 539 bp, Canis familiaris
tcatggcaaccttcaagccttgtgaatggaatgaaagtagaagttcaaaaacaagaggaactgagtgcgcaggaaaaaaatattggtacaacaaggagtcaaaagcagccaaacttagaaagttcttcggattctcccacattgcccaagttggaggagttctacatttctctggtcgagtcacagcagtcagcagaagggagtcagtttgagcctagtagcattcagactcaggtgaagcaaatgcagctgtccacagcagccctcagcacaactcctgcggcagttgattctccagaaaaacactctggttcagtggagagctctccagagagcctaaagaatgatttctctagtagccatgctattacagtattcaaagataagagtcatggagccatggaccagctctctttgattttgtctcctgagcaccaaatttcccagaagctctacattcctcggagtacagccactgctgccttaggagctgctgcacggttagccacctccaggagactcttacactggtatcccag

SEQ ID NO: 10795 - DNA, 574 bp, Canis familiaris
  misc_feature (221)..(221): n is a, c, g, or t
  misc_feature (421)..(422): n is a, c, g, or t
  misc_feature (449)..(449): n is a, c, g, or t
gcagaggacctgtacttgaagacaaggctgcagtttgatgaaacagccaagcatctacagaatctggagagcgccaccagaaaggcggtttgtgtagctgtgaaagaattcaacaagagccaggccaccgaatcactggaaaggaaaattcaagagaaaaaacaggaacaagaagacaacgtggctgagatctccaacctgctgcacggggacctgctctnggagaacccacagcaggcagccagctcctttgggccccaccgtgtggtgccagaccgctggaagggcatgacccaggagcaactggagcagatccgcctggttcagaagcagcaaatccaggagaagctgaggcttcaagaagaagagcggcagcgagatatggactgggaccgccggcgggtgcagatggctcgagccnntctcctcctggagcggcagcagcggcnccagcagcgtgacctgcgcagggccctggactgcaacaacctcagcctggccaaggagcagcgtttgcagaaaaaacatatggaggaaatctgtacaaatgaacccactgaagactatttcacgc

SEQ ID NO: 10796 - DNA, 308 bp, Canis familiaris
aaacattattggtaccgttcctcagtatatggatatggattctggctcagtactccaagcacaaatatttaacatgattcaacaatggcttttgaagataggcaatgagattaacaatggtaacattgaacttcagcgccacgtatatgaattgcacatatctatgatccagtggatggtaaacttgctgattttaatggtgcctgactttattgaccaagacactctcccaaatttgaagaaggaaagtactgagaaacatgatctaggagttgcacagttagagctagacgcgattgcactgacca

SEQ ID NO: 10797 - DNA, 159 bp, Canis familiaris
gaggtactattaactaagatggaaaacatgaagcaaagcaggtttatgtaagatgatggggaaaagtgcaatttccattgtgaactgccttccagaatttatggtagaccttcgctgacgttgctactgatgccaatgtggaataaagtatctggagtc

SEQ ID NO: 10798 - DNA, 451 bp, Canis familiaris
gaccaagcacatatgacagcctaacagattcgcttgttttaaagcaaagactgaattgaaagttatattatgttttagcataaactaatttcttttgagtttataaatcatttgtacccggaatgtattaatatattgccattaggttaatctgttacctgaatgcttccatgagcacaccgcgtcacctcagaactggtgcagcttctctcctcctccccacaagccgagcccctcgccagaaactgtcttcataacgccttatgcacatacaaagccaggagacatggagccttgttttccaaagtcagtcttcaaataaaaagttttattcagattaaaatgcttaaaacaaaatgttagtttctaactacagggtatgtcttaatctatatgaagcaataattgctttatcctcatgaagcaataaagtcatcagtccatttgttcc

SEQ ID NO: 10799 - DNA, 468 bp, Canis familiaris
  misc_feature (82)..(85): n is a, c, g, or t
  misc_feature (89)..(89): n is a, c, g, or t
  misc_feature (105)..(105): n is a, c, g, or t
  misc_feature (270)..(270): n is a, c, g, or t
  misc_feature (272)..(272): n is a, c, g, or t
ggttctgattctgagccaggaaaaggcaaaggtcggaatactggaaagtctcaaacaaacaaatcaactacaaatgagaaannnngagnaaaaagaagaaaaaangaaggaacagcaacagagtgaagcaaatgagctcaggaatcttgcttttaagaaaattccccagaaatcctcccatgccatttgtaatgctcaacatgagctttcattaccaaacccagtgcagaaggattcacgagaagaaaattggcaagagtggaggcaaanangatgagcagttgacatctgaaatgtttgaagcagatcttgagaaggcattgttgctaagtaaattagaatatgaagaacacaaaacggagtatgaaaatgctgaaaatgcttcaactcagtcaaaagttgtgaataaaaaagataaaaggaagaatcatcagggaaaagacaaacctctcacagtatcactcaaag

SEQ ID NO: 10800 - DNA, 521 bp, Canis familiaris
  misc_feature (350)..(350): n is a, c, g, or t
tgaagttgagcctccttcagctgaggaggtccctgcagaagaggccccaattgacgttcagtctccaccagctgagacctctcctgaagttcattctccactacttgaggaggcccctgtagaagaggccgcagttgaaatttgttctacaccacctgaggaggctcctaaagaagatacctcagctagagtttggtctgaacccgctggggtagctcttgttgaacctcagcatccatcagctgaagaaacgactttagaaatggtccctgttgacaaacagtttccagcagctgaagaggacttttttacacaaatttctgtagaagatgtccttgctgaagttcagnttccaccatctgaacacactgctgcagatgagcctttggtagaccatatgtctactgaatatcaacatctccagacagcagatgtcccagtggtaaaattagaatcactggttttggaagatcagcaaaaacctgaagagcctttggaactagatcctgtccctgaagatt

SEQ ID NO: 10801 - DNA, 526 bp, Canis familiaris
gatgttcctattactgtctatgcaacaatgcgaaagccacctgcacaaagcagcaaggaaatgcatcctaaatagcatcattaagtcttttgtagaggtttgactaggtcaagggtaatgggccagtatcatcttatgatctggtaaaacaaataaaagtggtggcacctttggatgatgacagcagttgaaatattttatttttagtaggagaagacacagtgtcatctggaacacgtgtagtgataagccatcagttatgtttgatagataagacggaatgatatttcacaattagaatgcactctagtgatcatcttgctcacagtggatcattaatatcaataactgaagatgaaggttaatctaccttgattatcagtcatgaaggccctgttctaaatacttattgtatcctaggctggtgtcctttgtttgtatttgggttgccacttagctgaatcctctcacttgaataccctaagccagttcctggcttgatatcttttgataacgctctgcggta

SEQ ID NO: 10802 - DNA, 478 bp, Canis familiaris
gaggaatttcctgctgaccaatcaaagctaaagggcgtggctccccattgtccctggagggtatataaagggctcaggggccctggagagggccagtgttgctacaacatggcggaggttattgaggcagtgctggggtctaattcagatgctgaaaacaaaaccgaaatcgcagatgtgagaaaagttccagaaatcaaagagaggaagaccccttgtcaatcgaaggacaaagaacgtgagaagctgcggaagatacttgcaaaagttaaatcggcccttcaggacaatgtagaaaagcgtaagaaaggaaggaaatcgaccatactggtctgttaccgcagacacagcaaagtgaagactgaaaatcagctgaagatgaagacggaagaagaaagcctgtccccactccgggcaacaccctatgcctgccaggggccaaagatctcaaagtagctgttacctccccagaaaaagc

SEQ ID NO: 10803 - DNA, 410 bp, Canis familiaris
gaaaaacgccgtgagtgtgcatcatgcgctggcatccaaggccacagactacgagaagaagccaaatgtgcttaaacttaaaacggctgactggagggtcttgctttttcaagcccagagtccagaggaaatgcaggggtggataaacaaaattaattgtgttgcagctgtattttctgcaccaccatttccagcagccattggatctcagaaaaagtttagtcgtccacttctgcctgccactacaacaaaattatctcagaaaacccgttatgaaatttatgtcagcattctaaaagaaggaggcaaggagctcctgagtaacaatgaaagtgaggctgtaggattgaagaagtcacattcaagtccttcgctgaacccagattcatctccagttacagccaaggtca

SEQ ID NO: 10804 - DNA, 542 bp, Canis familiaris
gtgaagctactttggatttgggacaagatggaaaaacagcaatacaaatctgaagttcataaagcttcattaataattgatttatttgggaatgagcatgataattttacaaaaaatctcgaaaatctcatgtctaccatacaagagagttactgttccaactggcgatgcccaactcgagtgcaggaagatcagcaacgcacaattaatataaatcctccccaagaaattcctcatggaaacttgatacgactggctgtggatgagttattctgttccaggattgaactgtgtgaagagagtgggtgtggtggcttaagagaattttcccagcgagttttctgccatggggcacccccttttgttgtcttaaatatgcagcattggaaatctgaagatctggcatatgtaccatattacttggatttatctgatcacaagtacttgttggaaggtgccacattatttaacaaagaggaacatcattattctgcagctttccagattgatggacattggatgcactatgatggcctcagaaa

SEQ ID NO: 10805 - DNA, 162 bp, Canis familiaris
tggaaccattgagctcctaaccatggggaatttggggaattacagacctgaggggatttgaaccacctatatccaagtcatgggcattcggtgttgtaaggatggccagttttgtgaaatcgtaatagaagagattgatgaaaccacattgctgaaagagaa

SEQ ID NO: 10806 - DNA, 353 bp, Canis familiaris
aggaagcattgaaaggatgaaacaaaatctgatgggaatgcaagctcaccctacagatttaagagagaaaatgagaaaggaactaacctttgaagagataagtagtactctgagcaatccagatcactttcaacttttattgccaaaaggcgaagtttcaagcaaaaaaagatgtctgattgaggagatttccagtacagagatccaggtagagatgaaggaaccaacctatgaattaaaaattgtggctgaccagaaggagaaacctcagaaaattgaaataaaagttgaattacctggtattaattcagtgtctctctgtgaccttagtgtttctgaggatgatttattga

SEQ ID NO: 10807 - DNA, 408 bp, Canis familiaris
aaaaattccaattcactctctcacactcttacagtatcactaaatttagaataaaaggaagcattgaaaggatgaaacaaaatctgatgggaatgcaagctcaccctacagatttaagagagaaaatgagaaaggaactaacctttgaagagataagtagtactctgagcaatccagatcactttcaacttttattgccaaaaggcgaagtttcaagcaaaaaaagatgtctgattgaggagatttccagtacagagatccaggtagagatgaaggaaccaacctatgaattaaaaattgtggctgaccagaaggagaaacctcagaaaattgaaataaaagttgaattacctggtattaattcagtgtctctctgtgaccttagtgtttctgaggatgatttattga

SEQ ID NO: 10808 - DNA, 387 bp, Canis familiaris
aaacagactgtaatcccatggagctgagtagcatgtcagggtttgaagaagatgcagagcttaatggttttgaagaagctgatatgaaagacatgaagctagaagctgaagcagttgtaaatgacgttctctttgctgttaataacatgtttgtctccaaaaacctgcgctgtgctgatgatgttgcctatatcaatgtggaaacaagagagaggaacagatactgcctcgagctcactgaagcagggctaagggtggtaggttatgcttttgaccaagtggatgatcacttacacactccctatcatgaaactgtctactcgttgctggatacactcagccctgcctaccgggaagcatttggaaacgcactccttcaaagactgg

SEQ ID NO: 10809 - DNA, 471 bp, Canis familiaris
  misc_feature (95)..(95): n is a, c, g, or t
gagccgaccaaaacgtatgactacaaaggagcgaagcaagatgggccatttaccaaaccaggagggacacatgagctaaggaatgaactcagggnagtgagggaagagctcaaggaaaaaatggacgagatcaaacagataaagggcgtaatggacaaggattttgataaactccaggaatttgtggagattatgaaggaaatgcagaaggatatggacgagaagatggatgttttaataaatatacagaagaacagcaagcttccccttagaagagggccaaaggaacagcaggaactcagactgataggaaaaacagacacagacccccagctccggctcaagaaaatggatggagcagatggaacaccactctctcttcacaagaagatcatggccctacaaaagacaaagaaggaccctctggattcccttcatcaatgtgggacctgctgcgtaagtgaagcctta

SEQ ID NO: 10810 - DNA, 61 bp, Canis familiaris
ttggcaaaaggaatatacatgacgcaagcagctatgactatggaagcattttcagatgagg

SEQ ID NO: 10811 - DNA, 312 bp, Canis familiaris
  misc_feature (48)..(48): n is a, c, g, or t
  misc_feature (63)..(63): n is a, c, g, or t
  misc_feature (97)..(97): n is a, c, g, or t
  misc_feature (108)..(108): n is a, c, g, or t
aggatgtgagcactggttgaccccagagccggacccaggcaattggangttccacatgccctntccattcttggaatgtacattctactcacccctnccacagtgggngatgttttcaaggacacagtgggagggagcaatgtgtaattgagactatctggatggcatatgtgatggagtcccattaagatctctctgtaaactattaagattcttgcaggtgctggcctcgtggttgcccaagggcatcaaagttattatgtatggaaccctaacctcaaaggattactctggagatttccttttaaggtg

SEQ ID NO: 10812 - DNA, 171 bp, Canis familiaris
aaaatgctcttcatccaggactaaagtcaagttttaagaagaaaagcagaaaacaaagaaattgacaatgaagtaactaagagagtcaaagatttctgacaaggctcaaaatgacgagtattttatcaaggggaactggattgactgaccaagtacaatcccagataaata

SEQ ID NO: 10813 - DNA, 294 bp, Canis familiaris
aagactttctcaatccttcttccaaccatcccctcctcctaactgacttctaagtgaagaaggaagctgtataattctttactcaccacatgctctacccagtcactaccacaataggcaagagagatggaaagactgacagaaaaacgaaaaaagggagacctgaatcaacacacgacacagggcagaaaaagtggtgaaggtgtgatgaatccgaaggaccaatgctgtagccgtcagtaaaacatacactgtgagcaattcactaaatggacatactctttcatttaatga

SEQ ID NO: 10814 - DNA, 288 bp, Canis familiaris
aaacttgatagttccctctgtggctgcagaccatcacacagatgacttgactgaagcctccacaactctgtctggttttgccggtgtcaagcttggcacaggctctgtcaagaaattagtaatcagaaactttaaagataaacccttgatactggaaaactacactgaagaggcatggcaaaaactaaaagaagctgtgcaggctatccagaacaatacctctgttcagtacagcttggaagaactctatcagagtgttaaaaacctttgctcctacaatttatctgc

SEQ ID NO: 10815 - DNA, 548 bp, Canis familiaris
  misc_feature (162)..(162): n is a, c, g, or t
  misc_feature (258)..(258): n is a, c, g, or t
  misc_feature (293)..(293): n is a, c, g, or t
  misc_feature (337)..(337): n is a, c, g, or t
  misc_feature (405)..(405): n is a, c, g, or t
gaagtggagaaagcctgtgccaacccagctaccggttcagttatcctactggagaacctgcgttttcatgtagaggaagaaggaaaaggccaagattcctctggaaataagcttaaagctgagccagataaaatagaaggcttccgagcatcactatccaanctaggggatgtctatgtcaatgatgcttttggcactgctcatcgggcccacagttctatggtgggagtgaacctgcctcagaaggcatctggattnctgatgaaaaaggagctggattactttgccagagncttagaaaacccagagagaccctttctggctatacttggtgganctaaagtggcagacaaaatccaactcatcaaaaatatgctggacaaggtcaatgagatgataattggntggtggaatggcttttaccttccttaaggtactcaacaacatggatattggtgcatcgctctttgatgaagagggggccaagattgtcaaagacatcatggctaaagccaaatcaaatggtgtgaacattacctttcctgttg

SEQ ID NO: 10816 - DNA, 520 bp, Canis familiaris
  misc_feature (195)..(195): n is a, c, g, or t
  misc_feature (211)..(211): n is a, c, g, or t
  misc_feature (286)..(286): n is a, c, g, or t
  misc_feature (493)..(493): n is a, c, g, or t
aaatgtgatcactcagtgggaggcaaagtataaagaagtaaaggcaagaaatgcacagttactgaaaatgcttcaggaaggtgaaatgaaagataaagcagaaatacttctgcaagttgatgaatcacagagtatcaagaatgagctaactatacaggtgacttcacttcatgctgcattagaacaagaaagatntaaagtgaaagtattncaagcagaactagccaaataccagggtggcagaaaagggaaaagaaactctgaatccgaccagtgtaggtgattncgttagcctatgaggtcaacacaaaaattaaaactttcagggttttgcaaaaatgtatatatttaatgctgtgcaactgctaaactatgcagtttttgttggagaaagttaaaatgatgagctcactaacagtctataattttatgaccttttggcttaaagtggaaagaagaaaaatagaattccagcagaactcaatgattattntttactatccatacttcttatcacttt

SEQ ID NO: 10817 - DNA, 451 bp, Canis familiaris
  misc_feature (287)..(287): n is a, c, g, or t
  misc_feature (295)..(295): n is a, c, g, or t
aaggatgttcaagatgggccacacaaagaagtcaaattgcctactagtgaagcacttctagaataccactgtcaaataaaggaaaatgcagtagaacgatatatggctcaaataaagagacttagagaaaagaaccaaaaatatcatgaaagaaacaaacgcttgaaggatgagcagacttggcacatacagaaccttctaaaggagctgagtgaagagaagtcagaggggttaccagttgtcacaagagaagatgttgaaaaagcaatgaaggaaaaatggaagtntgagaganaccaggaagaaaacttgaaagatatgcgcatgcaaataactaatgctgagaagctatttcttgagaaactcagtgaaaaggaatactgggaagaatataagaatgtagggagtggacaacatgctaaactcattacctccttgcagaatgacatca

SEQ ID NO: 10818 - DNA, 542 bp, Canis familiaris
gagtccacagatgcttttgaggccagcaaaaaggaagccagaatgtgtaggcaagagtttgaacaggtgaaaaaaaggagatatgaccttttcagccagtgttttgagcacgtttcaatctctattgatgaaatctacaagaagctctgcagaaacgtcagtgcccaggcatttcttagcccagagaacccagaagagccttacctagagggaattagctataactgtgtggctccaggcaaaaggttcatgccaatggacaatctgtcagggggagaaaagtgtgtggcagcattagccctcctgtttgctgtgcacagttttcggcctgctccattctttgttttagatgaagtagatgcagccctggacaacacaaacattggcaaagtctcaagttacatcaaagagcagactcaagagcagtttcagatgataatcatttccctaaaagaggagttctattccaaagccgatgcgctgataggcgtctatccagagcatgatgactgcatgttcagcagagttttgaccctggatct

SEQ ID NO: 10819 - DNA, 213 bp, Canis familiaris
tgtgctccagcaaccagaacagaagcatggaggcacacaacatcctcaacaagcggggattcagcgtccggtcttttggaacggggacccatgtgaagctcccggggccagcgcctgacaaaccaaatgtttacgatttcaagaccacgtatgatcagatgtacaatgacctccttcggaaggacaaagatctctacacacagaacggcatat

SEQ ID NO: 10820 - DNA, 527 bp, Canis familiaris
  misc_feature (257)..(257): n is a, c, g, or t
atactctaacatgtggaccctttattgtctaactgatatgaatcaacagagtcgcccatcaccgccacctgcacctgggcctttcccccaagcaaccctctatttatctaatcctaaggatccacagtttctgcagcagccaccgaaagttacttctccaacttacgtgatgatggatgacagcaagaagaccagtgccccaccttttattttagtaggctcgaatgttcaggaagcccaggattggaaacctcttnctggacatgctgttgtttctcagtcagatgccttgaagagatacgctgcaatacaagtacccattgctgttcctgcagatcagaaattccagaaacatagcccaaacccccagaatggtagtcctcctacaagtggacaagatgtccccagttttctttctgttgcattcccagtagatgtagccaaaaaaggttcaggatctggtgacaaacgtactccctttggaagttacggtattgctggagaaataaccgtgactactgcccatg

SEQ ID NO: 10821 - DNA, 248 bp, Canis familiaris
tacgtgaccagcacgcacttctggggtcccctggccaactggggcctaccgctggccgccattaaggacatgaacgcatcgcctaccataatcagtggccctatgacgacagcactcatcttctactcaatggcattcatgcgtttcgcctaccgtgtacagcctcgaaacttgctgctgctggcgtgccatagcaccaacgtggtggtgcagagtgtgcaggtgagccgctacctaattcaccagta

SEQ ID NO: 10822 - DNA, 35 bp, Canis familiaris
tttgattcaggtatgcttcttactaactaagcaac

SEQ ID NO: 10823 - DNA, 419 bp, Canis familiaris
aaaaagactgaattggctctggccaagaattacccaggaaaaaaagtatccagtactaacaacactccaattccaaggctgacctccaacccatctcgagttgatcgcttaattgtggatgaactacgggaacaagccagagttgtgactctactaggcaaaatggaacgtcttcgaagttctccccttcatgccaatatctctactgctcttgatagacacttggggtccattcacattgtacagtcacgtagaaaggatgaaattgttaatgcttcaaacagacaaaggcaaggagttcctagatgccaagatgacagagatgtttttgcccttgcttcagcaattaaagagatgtgtgtggctactcggaaagcacgtactaccctgtggtgtgcactgcagatgaccttgccaaa

SEQ ID NO: 10824 - DNA, 524 bp, Canis familiaris
gaggaccaagtccagatggccgactatgcgcttaaatcagcaggggcctctattgtggaagccgggacctcagaaagttacaaaaataataaagcaaaactttactggcatgggattgggttcttaacttatgagatgcctccagatattatcctccagccggacgtccaccctgggaagtgctgggccttcccaggttcccagggtcacgccctgatcaagcttgccaggaagatcgtgccaaccgccgttaccatggagcacatctcagagaaggtgtctccctcagggaacatctccagcgcacccaaggaattttctgtctatggcatctcgaaacagtgtgagggagaagagattttcctaggtcagttcgtatataacaaaacaggaagcactgttcagacattcgagctccagcatgatgtttttgaatccttattatgtgtaaaactgaaaatcctcagcaactggggacacccgaaatacacgtgtttatatagattcagagtccatggcacccc

SEQ ID NO: 10825 - DNA, 409 bp, Canis familiaris
acccgcattttcttctatgtgaggcggagggtgcagcgcatggcagagcacgtcagctgccacccgcgataccgagagaccacactcagcctggtcaagaccgttgtcattatcctgggggcgttcgtggtctgctggactccaggccaggtggtgctgctcctggatggtctgggctgcaagtcctgcaacgtcctggcggtggagaagtatttcctactcctggccgaggccaactcactggtcaacgccgtggtgtactcgtgccgagatgctgagatgcgccgcaccttccgccgcctcctctgctgtctgtgcctacgccggtccacccacgagtctgcccgctatgcaccctccgcccgaacaggtgccagcactcgcatcatgcttcctgagaatggccact

SEQ ID NO: 10826 - DNA, 433 bp, Canis familiaris
  misc_feature (57)..(57): n is a, c, g, or t
  misc_feature (368)..(368): n is a, c, g, or t
gaggatgctcgtcagaagttccgctctgttctggttgaagcaaccgtcaaactggangaactggtgaagaaaattggcaaagccgtggaggactcgaagccctactgggaggcgcggagggtggcgaggcaggctcagctggaagctcagaaagccacacaggacttccagagggccacagaggtgctccgtgccgccaaggaaaccatctccctggctgagcagcggctgctggaggatgacaagcgacagttcgactccgcctggcaagagatgctgaatcacgccacccagagggtcatggaggcggagcagaccaagacgaggagcgagctggtgcacaaggagacggcggcccggtacaacgnagccatgggccgcatgcggcagctggagaagaaactcaagagagccatcaacaagtccaagcctt

SEQ ID NO: 10827 - DNA, 331 bp, Canis familiaris
ccagccaccagaaatccgttgaaatttgtccccagggactggtgttcgcaggatcttccgaacaggattccaacttggccaagcagttctggatcgctgcgtcactgtatcctactactgaatcccagttggtgctgccccgaggtagcagccagcgcctgcgggtggcccggccctctaggccccctgggcatggtgaattgaatttgactttatttcctttagagaatacagatgtcactgctgaaaccataaagattcaggaatctgaggagaaagaaaagtatcttcaaaaggctaaaaggagagatgagattctacaactcttaag

SEQ ID NO: 10828 - DNA, 568 bp, Canis familiaris
gatacaagcatctcatcagcagaaccaaagagcaaaagcagcctccacttgctggcccatgaaacaaaaattggatctttcttaagtaacaaaaatctagatgtcaaagacaaagctggtctttgtccagatggtgatatggaaggggattctttctttgatgatcccattcctaaaccagagaaaacttatggttggagaagtgaacctagtaagcaagcaggaagccttgcatcactctctgatgcgccccctctgaaaagtggactcagctcccttgctggagccccctcactgaaagactctgaaagtaaaagaggaaacgcagtgttgaaagatctgaaactggtcaatgataaaattggatcgctcgggttaggcactggagaggaagatgactacattgatgacttcaacagtaccagccatcgatcagagaaaagtgagctgagtattggtgaagagatcgaagaagatctttctgtggaaattgatgacctcaataccagtgataaacttgatgacctgacacaggacctgactgtgtcccagctcagtgatgttgcgg

SEQ ID NO: 10829 - DNA, 510 bp, Canis familiaris
  misc_feature (431)..(431): n is a, c, g, or t
gtgactgagctgatggaaactgtaaataagacagaagcaggtcaagtgggtaaaaacacagtccctgcagagcaggagaaaaataatgaacactccttccaagatattgatgataagttatctgaatcaacagatgatgatggtgaagatgataccaatgatgaagatgatgaagacagtaaccctaataaggatactcatgccccattagagttaatggcagaattcctacgagcagaaatgggtcaagactaccatttggcaaaaaaattatgtcagatgatcctaatctatgaaccagaaaatcctgaggccaaggagtttttctcccttattgaagaaatgttgctgatggagaaatctcaaaatcttgaggaagatgatgaagatagtgaagaagacagtagcggtgagagtgaaggagaaagcantgaggagttaagtgaagaaagttctgatgaatgtgaagacgagtgatgaaagttgctgctgtggttcaatcttcatgta

SEQ ID NO: 10830 - DNA, 547 bp, Canis familiaris
gcaacgggaagctgtatatcgtgatggaggcggccgccaccgacctgctgcaggcagtgcagcgcaacgggcgcatccccgggagtcaggcgcgcgacctcttcgcgcaaatcgctggggctgtgcgctacctgcatgaccaccacctcgtgcaccgtgacctcaagtgcgaaaacgtgttgctgagccccgacgagcgccgcgtcaagctcactgactttggctttggtcgccaggcacacggttatcctgacctgagcaccacctactgcggctccgccgcctacgcgtcgcctgaggttctcttgggtatcccatacgaccccaagaagtacgacgtgtggagcctgggcgtcgtgctctacgtcatggtcaccgggtgcatgcccttcgatgactcggatatcgctggtctgcccaggcgccagaagcgcggcgtcctctaccccgatggcctcgaggtgtccgagcgctgcagggccctgatcgcagaactgctgcagttcagcccctctgccaggccctcagcgggccaggtagcgcgcaa

SEQ ID NO: 10831 - DNA, 253 bp, Canis familiaris
aaggcaaatggtgcttcaccctgacctcgcataccaagataacctccaaggaaccactgtttgatctgctcatcttttattgaagttacctcactccaagagtgggagcttgagctctcatagaaaattgacaaccagagagtcttctaactttgggaacccagagttcatccccctcagccctgtcattctcctgttgagtatcttacccagctgcacatgatgactgtgtggtctagaacccagtcctaaa

SEQ ID NO: 10832 - DNA, 460 bp, Canis familiaris
aaaggtgcagattctctggaggattttttgtaccatgaaggatatgcttgtaccagtattcatggagatcgatctcagagagacagagaagaggcccttcaccagttccgctcaggaaaaagcccaattttagtggctacagcagtagcagcaagaggactggacatttcaaatgtgaaacatgttatcaactttgacttgccaagtgatattgaagaatatgtacatcgcattggccgtacaggacgtgtaggaaaccttggccttgccacctcattctttaacgagaggaatataaatattaccaaggatttgttggatcttcttgttgaagctaaacaagaagtgccatcttggttagaaaacatggcttatgaacaccactacaagggtagcagtcgtggacgatctaagagtagtaggtttagtggaggatttggtgcccgagactatcgacaaa

SEQ ID NO: 10833 - DNA, 588 bp, Canis familiaris
gaaatgctacaaacaggcagctgacaaagctagagaagatctgctgaaaactcaaaaagaacgggattttcaccgaatgcaccacaaacgaatagtccaggaaaaaactaaattaattaatgacctcaaagggttaaagttacattatgcatcgtatgaaccgactatcagggtgttacaagagaagcaccacactttgctgaagcagaaaatgctgacctctctggaaagagacagagcagttgggcagatttctgggcttcaagcaacactgaagcatatggaaatagggcataattaccatgcttctgcaactagagacactaagaataaattctgttatcttgtagttggtcctaactctgaaaaagaaaatgcaccagaaggtcctactcagaaaggtcttcatgaagccagggaaaaaatccaaagtaaaacaaaggtaaaagataatacaaaggattcagaatttcccacagatatgcaacctaatccaaacctgtatttacataaagaaaatatttgtccagcaaaatttgactacaagctgaatagcatttttagacttcatgaacttccagtgagctg

SEQ ID NO: 10834 - DNA, 578 bp, Canis familiaris
attcattttcccaaatttcacctcgggatttaatgatcaagttcactttcattgtgatgagggttatcacttagaaggagaagcaattttgacttgcaaccttcaaggagatgaggtgtattggagtgatgaattcccacaatgtgaaaagatttactgtcaaccacctgcaaaaataaaaaatggaaaacacaccaatagccacagaactatttttgaatataatgaattaattacttttagttgtaatcgtttaaaaggatcagatcaatattcccttgttggagaaagagaacttacttgtattgagaaaaacaagtggagtagtcgccctcctcagtgtaaagtggtcaaatgtgactatccagtaattgaacatggaagactgatatcaggaatcaaagaaaaatattactaccaagcaatggttctacttgaatgcctcccaggcttctatcttaatggcagcaacagagtgttctgtggtgagaatagtacttgggatcctaaaataccaaaatgtattaaaggtttcaagcctactcatccaaccaaacctccagtttcaagatatccag

SEQ ID NO: 10835 - DNA, 543 bp, Canis familiaris
gtggcttcttcctcactggatacaactagtaaaatctgggatgttaacagtgaaagatgcagatgcactttgtacggacatacagattctgtgaacagcattgagttttttccttgctccaacactcttctcacaggttctgcagataagtccctgtctatatgggatgcaagaacaggtaactgtgagcagtcactttatggtcacatgcattctatcaatgatgctaccttcactcctaggggtcacatgatagcatcctgtgatgcttgtggagtaacaaaactatgggactttcggaagctcttaccaattgtgtccattgatataggtccaagtcctggcaatgaggtgaacttcgattcatcaggtcgagttttagctcaggcgagtggcagtggggttatccatttgctagatcttaaatcagggcaaatccacaaattgatgggccatgatagtgaggctcacacagtcgtgttttctcatgacggagagtatttgttttccggaggctctgacggcactgttcgaacgtggtct

SEQ ID NO: 10836 - DNA, 558 bp, Canis familiaris
agaataaaagctccactgcttcctctgtggcggcctcctccccgcagtccggagggaacatccaggaggtacagagaaaaaagtcccaaaaatgggatgaatccaacatcctggcaacacaccgtcgggcctacagagactatgacttaatgaagataaacgagcccagcagcccccactgcggccagcgagactacggagaagacccagggagcgacttggacgcaaaggacaccatgagcccggacgtcgtagctaagaaactggccgccagcgggacctcgcgatggagccgtcaggtgggggagcccgacagtgatggagcacacagtagcaagacctttttcgacgcgcaggaaaagcagcggcagttcgaaatgaaaaggaaactacaccacaacgaaggcctgaacatccagctggccagacgactcatctccaacgacctgcagcacgagaaagacgaggatgacaacggaggagcaccacgtggtgccagcgaacacagcaccggcctggaagagtcctcggatgaagtttctacaagcgacgaaccgc

SEQ ID NO: 10837 - DNA, 562 bp, Canis familiaris
tcatagtggctggtatcatcgtgtagagaacaatggctggaggcctgtctctgatacattttggatgtctactgaaaatgtagagttggaagacaaaaaagaaactgaattccatttctctaaactaaagagaaggcaggatatggaaaagaaaagaaaaattagaaaaatagaatggatgagaaaaatgtactatgcaggaagcctacaggctaagtcaacaaatcctaaaactctagatttaattcacacagcaacccaggggctcatgagatcagtcgaaggcagtggaatagatgctgtgatggaatgggaagtggatgaagtgctaaactggacaaatgcactgaactttgatgagtatattgccaactggaaggaaattgctacaagcaactcttcagctaacttcacaagtttcacacttgagcaagcacagaaaaaaagatatgactatgcagatatgtcagaggagaaaatgggaacaccagaagatactttatatggaaatatttttaaaaaaccaaattatgctagactaacgcctgattccacttatgga

SEQ ID NO: 10838 - DNA, 442 bp, Canis familiaris
gggtcgtcagaattattccgccgaggtggagtcctccatcagctgcctggccaacatgcacctgcgggcctccaacacctacctctccctggccttctatttcgactgcagcgaggtggctctggaggccttgggccacttcttccgcgagttagcccgggagaagcacgagggcgcccagcggctcttgaagttgcaaacccagcgcgtcggcaacgccctgttccaggacgtgcagaagccgtcccacgacaagtggggcaaagccctggacgccatggaaactgctgtggtcctggagaagaacctgaacgaggcccttctggatctgcatgccctggcttctgcccaggccgacgcccatctctgtgacttcctggagggccacttcctaggccaggaggtgaaactcctcaaggagatgggcgatcacctgactaac

SEQ ID NO: 10839 - DNA, 580 bp, Canis familiaris
  misc_feature (510)..(510): n is a, c, g, or t
gatgggtaagagcaatgtcctctctgatgtaataggccttttaatggtgaaggaaatttccaattctgaatttcaacctccagtagaggacaaagtatcaagttcggaattagttctggaagctgtcaaaatcatagaaaaagtgctcagaattgttgatgagtttaagtccggggaaaagtcttcatccaaaaagcatcctatgctagacgccaggcttgtagaggaagcactggccttgttcttggctaaaatagtaaggttgcaaagtatctcatgcaaagacgcaaaaaatgtatcaaagcctgagttaaacaaaattgtatcccaactgatgaaatctgtgacagctgaaatttcccagagtaacattaatcttgttgctgctgatcctgaatatcttttaaattcagaaagtatagaaatgatttctcaggttattgattctgtttatagtaacgtactgcaacagtctggaacccaggaggaactttatgatgatctaaaagntacaaacactgttttccctaaaaaagtggctagtttaatcattaatggagtttcacatcttccagtagat

SEQ ID NO: 10840 - DNA, 539 bp, Canis familiaris
tgttgtcagtccacatccagtgtaaatattgaatgtattgaagcaacctcaaatcacataatagaacctaaggcgagaaaagttaaaagaactattgctgagcttgacatggctatgtgctcaagaaacatgactgaaacaggctcttgggagaaaaagccacagagtaagaaagaagacaagactcttaataatgaaccaacacattacttcatacatagaattatgagttcatcctcatacaaccaagaagatctgatttcatctgccagacacgcctcagaattctggggatctctcccatttcagttttgttcccgtggaaattctcaggagcaaaggccagagaattcaaacagtcttaagtttatcaccatctttgaaggaaacaagaatattcatggcagtgggtattcctcaaaagaagtcatttcagaaactgccaagccaagtatttccaaacaaggatctaaaatgctggcgaaggtatcttcagctctgtcaaaggtgttttctcgaactaacaccaatatctccaa

SEQ ID NO: 10841 - DNA, 230 bp, Canis familiaris
gaaattacaatgtctaccagccgcaaattaaagagccatggcatgaggaggggcaagaaccgagctcctcacaagggagtcaagagaggtggcagcaaaagaaaataccggaagggcagcgtgaagagtaggaaacggggcgatgatgccaatcgcaattaccgctcccacttgtgatgccacccgtgggctctgtcctggtggacttcacacagcaccaggcagcaaag

SEQ ID NO: 10842 - DNA, 172 bp, Canis familiaris
  misc_feature (85)..(85): n is a, c, g, or t
  misc_feature (131)..(133): n is a, c, g, or t
  misc_feature (136)..(136): n is a, c, g, or t
  misc_feature (139)..(139): n is a, c, g, or t
  misc_feature (141)..(141): n is a, c, g, or t
actaatattggtactgctggtgttcccaccacagtccagagggtcttagaagaggatgagagcttaagaacttgccttagtgaanatgcaaaagagattcagaacaaaatagaggtagaagcagacgggcnnncanaananattttggatgctcagaacctaagttcaagaa

SEQ ID NO: 10843 - DNA, 515 bp, Canis familiaris
atctgcatgagaggccaaactttgaagattctaaaactacagagtcaccactgttgttacaagaaatagccctcagaagtaagcctataactgaacaatatcaaggactcgaaagattctttgtttttgataacaatgaaagactcaacttacttccttctcatagcttagaatgcagctattccagtactaggattacaattgcaggagatggagagtggatgccagaccatagcgtaagtgcatttgctgataatgcagttgccttgggtgttctgcagagtgcccagaacccatcagtgagtagaacagagcagaagatgggccagataccgcagagaccttcaacagcaaatttacccctttccagctctgttaaaaaaagttccagctgccttggctcctcccatcctcgatcaaaaagtgcagctgctcgatcattatctagagctgcttctgaaatttcagaaattgaatatattgatattactgaccacaacgagcctttcttagat

SEQ ID NO: 10844 - DNA, 564 bp, Canis familiaris
ccgactcttccatcaggacaagcagctgctactgtcctacctggaaaagtgtttgcagcgtatctcccagtcacctgcttgtccctggggtccagtcaccacctactgccactccctcagccctgtggagaacacagcagagaccagtcctcagggctgcccccgctacaagaaaaggcgtactgaaggggatgtctcttcgtctcaggaagaaagcctgcagctgaacagcatcccacccacacccaccctcacctcgacaggcatcaagaggaggcagcccctgagggggttggaagaggtggaggaagaaggccgctcagaaccagagctgacccagggccaacccctgtcaggcaaccagaggtcaaggttctcaagtccacagcatttccagactctcctcaacccttcaggtcctggtttgggcaaccggctgacccgcctcagcctcatggaagaggatgaagaagagttggaaattcatgagttaagtgaggaatggcaagaaacagacaagcacacttcccccagtgagcacgggctggacctcttagattctac

SEQ ID NO: 10845 - DNA, 446 bp, Canis familiaris
  misc_feature (237)..(237): n is a, c, g, or t
gttttctgatgatactctagcaaaaaagagctctacaatgccttttctcagggaacctctaatggaaaaagtattttcatacctgtcaacaatttcattagaagactgtactgaaaatgaactgaatatgacactttatgatgatcagaaagatgacagcattaaggaaatattttcacgaagacatacagaggttgaaatacaaaaccttcaacacaatattgaatgacttttttncttttgaaactttgttacactgaaatcatggaaagttaaaactaaattaccagcttctgagtttcttaacatgctcatactattacttttcttgtcctttaccgttgagtggtcctacttccctcaccaattcttatttctagaaacaaaattataggaagaatagagtgacatcatgaacattaagcttaactccttgtatctcatca

SEQ ID NO: 10846 - DNA, 482 bp, Canis familiaris
  misc_feature (45)..(45): n is a, c, g, or t
atggacttctggtgtgcccgactagccaccaagggctgtgaagangttcgagtgtccggctggctccagacagaattccttagcttccaggatggggatttccccaccaagatttgtgacacagactatgtacagtatccaaactactgtgccttcaaaagccaacagtgcctgatgagaagccgggaccggaaggtgtcccgtatgagatgtctgcagaatgagacttacagtgtcttaagccaggccaaaagcgaggaccttgtacttcgatggagccaggaattcagcaccttgactctaggccaagctggatgaactcaggtccatgctacctccaccccagccctaccttcccacattctccattgcctttagaccccatctgtcagtttgctttcctggctgccacttgtgggtctctcaccttgccctgactcacatttgccttgggttggagcagcagtcccagagaggtccat

SEQ ID NO: 10847 - DNA, 525 bp, Canis familiaris
gatcactgacactgagggcatctctcaccctcgtctgggcagcctggatctcaaagggaaccgcatccgcagggtgacaggtctggacccccagaagctgctcagcctgcacacactggagcttcgggggaaccagctggagagcactctgggaatcaatcttcctaagctgaagaacctctacctggcccagaacatgctgaagaaggtggagggtttggagaacctaagcaatctcactaccttgcatcttcgagacaaccagattgaaactctgagtggcttctccaaggaaatggcatcactgcagtatctcaacctgaggggcaacatggtgacccacctggaggagctggccaagcttcgggacctgcccaagctgcgagccctggtgctattggacaacccatgtacagatgaggctgactaccgccaggaggccctggtgcagatagcacacctcgaacgcctggataaagatttctatgaagaggaggagcgggccgatgctgatgagatccgtca

SEQ ID NO: 10848 - DNA, 501 bp, Canis familiaris
ctttttgtgctgtggtggatggtattcaatataagactggactgggacaaaataaaaaggagtctagatcgaatgcagcaaaattagctcttgatgagcttctacaattggatgaacctgaaccaagaattttagaaacatcaggtcctcctcctatccctgcagaacctgttgtttcacctgaaccagcatatgtctcaaaagtacattatgaagggagacatattcagtatgcaaagatatcacaaattgttaaagaaacatttaataaactaatttctaatcattccgaatatctgaaatgtagcaattcattggctgcttttataattgaaagagctggacagcatgaagttgtagctataggcacaggtgaatacaattacagccagtgcattaagccaaatggaagagtgttgcacgacactcatgctgtcgttacagccagaaggtctctccttaggtacttttatagacaacttctactcttctacagcaaaa

SEQ ID NO: 10849 - DNA, 523 bp, Canis familiaris
ggagtatgactttgtctttccctaaatctgcatgcagaaaggaatgagagtggatgcacaaaaccaaatttgaactactaccacactgaagtacatgatggccatgcaaggcatgaaatccaaaaccacaaaagaggtgttccctctggcacatgtgtccaacgacaccaataagatgacattaattaacccccaaggagtcaagctcaatatctacaagcaaaaagtggaacaggcaattaagagctatgaaagacgtttgaataaaattgtttggagagcattatctcaagaagaaaaagaaaaattagatgcatataagcccatgcggtacttagagaacaaggcagctttaaacagggcattagaacggttgaattggcccatttcattgaaggagctgtcgatgctggaaaatgaaatccttgctgggaaaatgtacatccaacaggctatggaactccaggaggctgccaagaaggagaatcatgcaaacaagtcacaaggagagcaacaaaaagtt

SEQ ID NO: 10850 - DNA, 307 bp, Canis familiaris
tgcagacagacccagagctcaagttccagtcagaatttgtgtcttccaaccctttctccttcactccccgggtgcgggaagtggagtccacgcctatgatgatagagaacatccaggagctcattcgatcagcccaggagatggatgaaatgaatgatctgtatgatgaagaacccgtctggaaaaagccaacccgtgacagcctcctgcagatgccccacgtagaggctttgctggtgctgtgctattcgattgtggagaacacctgcaccataacccccacagccaaggcctggcagtacgtgga

SEQ ID NO: 10851 - DNA, 196 bp, Canis familiaris
ctgctcagatgttaggtaatgtttcatctactcattctgatcagtctgacgttttaatggtggatgtggcaacaagtatgcctgttttttctgaggaggtgctgagttcagaggctgccgaagatgccaaggtggccattcccactgtgtattccgcagaggttgtagccctgcaggttctgagccaaacatctgt

SEQ ID NO: 10852 - DNA, 389 bp, Canis familiaris
atggacctcaggcaggccagttcaaggaactgggtgcagctcgggaacctgctgtgccacaccctctagagctgtcagaattccagagcttccctgtgtttgaggacattagccatcacatcaaagaggtgggggcccaactggtaaagaaagtcaatgccatctttcagctagacatcaccaaagatgggaagatcattctgcagtggaccattgatctgaagaatggttctggagacatgtatccaggatctgccaggctcccagcagacactgtcttcacaatcccagaacctgtctttatggagttggttttgggcaagatgaaccctcagaaggctttccttgccggcaagttcaaagtgagtggcaaagttctgcttggtcag

SEQ ID NO: 10853 - DNA, 169 bp, Canis familiaris
  misc_feature (68)..(68): n is a, c, g, or t
  misc_feature (75)..(75): n is a, c, g, or t
  misc_feature (91)..(98): n is a, c, g, or t
tgtcggtgcggacactaccgctgctcttcctgaacttgggcggggagatgctttacatcctggaccancggctgngggcccagaacatccnnnnnnnnaaggcccacaaagttctgaatgacatcatctccaccatgttcaatcgaaagtttatggaggaattgttcaa

SEQ ID NO: 10854 - DNA, 398 bp, Canis familiaris
  misc_feature (288)..(288): n is a, c, g, or t
gatattctcttggataccactgacccagcgaatgaagatgtctcaataacttctgaagtctctggcacattaaaggaaggcaccaccagcattgcagacacccctaatcttccagctaagaaggataagcctgatgataacaattatagttcctcagtaaaatccaatgtcactgctaatgaggcagtccagatcaccaactcgtctattcctgaggctgaaatctctactgctactgaaaaaaatttcactattccagacataactgcctttacagaagagaaaatnaactgaaattgacttaagtcttccagagaatgaccccaatcctgtgcctaaactaacagactctgatgaggaaaagttcatcactgtgtttgaactcactaccactgtag

SEQ ID NO: 10855 - DNA, 224 bp, Canis familiaris
gatgaagatctctatcgtataaaagatcctgtgttgtttgtgtcaggctcagcagatgaaatgtgtgaaaagaacttgttggagaaagtggcacagaaaatgcaagctcccaataaaatccactggattgagaaggcaaatcattccatggcagtgaaaggacggtcaacaaatgatgttttcaaagaaataaatacacagattttgttttggatccaggaaat

SEQ ID NO: 10856 - DNA, 248 bp, Canis familiaris
  misc_feature (37)..(37): n is a, c, g, or t
  misc_feature (96)..(96): n is a, c, g, or t
  misc_feature (123)..(123): n is a, c, g, or t
  misc_feature (134)..(134): n is a, c, g, or t
  misc_feature (187)..(187): n is a, c, g, or t
  misc_feature (217)..(219): n is a, c, g, or t
aagcagcaaaacagatgccacacagaattgagcaacnattctagacagctagttttaacatctaagaagcttgcccaccaagcaaaaatcttaatnaattaaagaaagtgagcatttaaggtnttaagcactgntaacgcactcttcttatgcttttggttagcaattcaagaacatgtatcttcantctttcctgacgcagacttttaaaataggnnngttttcattttgctgatttttcttcaata

SEQ ID NO: 10857 - DNA, 480 bp, Canis familiaris
atggcatcatgctgcttagtgctgcagacagaaagattgtcgcagatattaaggaaacctcttgttatgtggtaatgaactatgaagaagaaatggccaagaatcctgaatctgtggagaaagtttaccagctacctgatgggaagatgatcaagctccataaccagctctttcattgtccagaggccctcttctctccacatcttctgaaccttgagactcctggcatcgataagttgtgtttcagcagcataatgaaatgcgatacagatctcaggaattcgtttttctccaatattatccttactgggggatcaacctctttccctggtttagacaagcggctagttaaagatatagcaaatatggtgcctgccaatacgcccgtgcaggttacagctcccccagaaaagaaactatcagtgtggatgggaggctcgattcttgcatccctgtctgccttccaggacatgtggatca

SEQ ID NO: 10858 - DNA, 444 bp, Canis familiaris
gcaagattccttggcttagcgaggccagcctcataaacaagccattagtgctcagcctccccaaaagatatcctcagaattctggcactttcctgatttcatccaagaaggatatgaatttgcctattttatttcaagttccagatgtcttatctaaggccaggaggatccagagtaaccccatgctgatcagaaataagcagctgtgctccacatgtcaagaaataaaaatggtacaaccaaaacctgtgataatccctcataatctgaaactatcctttgagaatcttatgagtcatagaatgagtcttcatccaccaaaagcccaagctgtactcaaacattcccataatgacatctcaacagagagcattcactacagactgcccattctgggccccaggacagctgtcttcaatgaactgctggcagatacctatgcaa

SEQ ID NO: 10859 - DNA, 552 bp, Canis familiaris
gaaaagagcagagcaacttcgcaaagaacttgaggaaaaagagcaagaacgcttggatattgaagaaaaatataccagcttgcaagaggaagcacagggaaaaaccaagaaattaaagaaagtttggactatgctaatggctgcaaaatcagagatggctgatctccaacaggagcatcagagggaaattgaaggcctactggagaatattcgacaacttagccgggagctccgacttcagatgcttatcattgataactttatacctcaagattatcaggaaatgattgaaaactatgtccattggaatgaagacataggagaatggcagctaaaatgtgttgcttacacaggaaataacatgaggaagcagactccagctcctgataaaaaagagaaagatccctttgaagtggacctttcccacgtgtatcttgcctacactgaggagagtctccggcagtccttgatgaaattagagagaccacggacttctaaggggaaagcaaggccaaagacagggcgaagaaagcgttctgcaaagcctgaaac

SEQ ID NO: 10860 - DNA, 577 bp, Canis familiaris
ggaattttaccaagcatacctcaatgtaattctggaaaactggatacacctgaaagttcagcaaatacctatcagaatataacaatagatgatcaattctctatcaaatcagatgattcaaagtcaaggaaattaatctatgaatataaaattagccaacattttcccaggtatcttcaagatttaccaactagaactgttggaaaaatgtcatctcaaacatttcttccttctattgctcacaagaatatggtatgttccactggaatggaaagcccatgtatcagtgaaaaacactacactggtcaaagccagaagatggccaaagactgtaaacgtattaaccacaatccaaagaagactcttggtactagaataaaagaagagaagaagagatcaagtactttcctcccagaagatttaaatcttgatgtcaatcggggtacaactaagattagttcgcccaaaagatgcaataattgcatgggaaaaattagacaaaaatgtagtaatctgtcaagaaggcctgaatctcatcctctaaagacaaaaagtcctgagctatctttaatattgg

SEQ ID NO: 10861 - DNA, 587 bp, Canis familiaris
cactgccttgttgaactacacatgtgtaagcataatataaaaaactgtggtataaaacagttatgtgatgcactgtatctaaatggaagcctacgctaccttgatgtcagctgcaataaaataactcgtgatggaatggtgtatttggctgatgtactgaaaaccaatactaccctggaagtactagatctttcttttaacagaatagaaaatgcaggagcaaagtatctcagtgaaactcttgcttcacacaacaggagtcttaaagcgctgtcagtagtcagcaacaacatagagggagaaggccttgttgcactttcgcagtcaatgaaaataaaccccaccctctcaaatgtctacatttggggaaacaaatttgatgaggctacatgtgtggcatattcagagttaatgcaaatgggccgtctaaaaccagacaatacagacgtggaggcatttgtggtggatggacatgtgtatcttgcagaagtctcgaatggccttaaaaagcattattactggaggccaacttatggagcagcttgcaggcactcagctaatgcaggttttactcttgtaccagtagg

SEQ ID NO: 10862 - DNA, 327 bp, Canis familiaris
aagctcacctatattccagaacacattagcaaactacagagtcttaaagagttgtatgtggagaacaatcatctggagtacctgcccacatctttgggatcaatgcctaacctggaaattcttgactgccgccacaactggcttaagaaacttccaaattccatttgccaggcacaagctttgaaagaattactgcttgaggacaacttgatcacctgtcttccagagaatttggataacctggtgaacctcaaggttttgacactgatggacaatcccatggaagaccccccaaaagaagtgtgcattgaaggcagtcaggctata

SEQ ID NO: 10863 - DNA, 230 bp, Canis familiaris
  misc_feature (135)..(135): n is a, c, g, or t
  misc_feature (188)..(188): n is a, c, g, or t
tccaagtacgtggagacgagccacctcgcaaaccaccccaaggtggccagaaggccctcttgccgcagcagcccccattgcctgctctgtacagaacgtccctcgggcccctgcagccccaccttcctggaccangtcatcagaggcatcaactaccttgacagatccaccaatgccttctgtaccancggtcccaagtcatcactgagcctgccaaggcttgcagccaa

SEQ ID NO: 10864 - DNA, 363 bp, Canis familiaris
aagcgcgagatctttgaccgctacggggaagaaggcctaaagggtggtggccccagtggtggcagcagcggtggtgctaatggtacctctttcagctacacattccatggagaccctcatgccatgtttgctgagttcttcggtggccgaaatccctttgacaccttttttgggcagcggaatggggaggaaggcatggacattgatgacccattctctagcttccccatgggcatgggtggcttcaccaacatgaactttggccgttcccgtcccgctcaagagcccacccgaaagaagcaagatccccccgtcacccacgaccttagggtctcgcttgaagagatctatagcggctgtacc

SEQ ID NO: 10865 - DNA, 449 bp, Canis familiaris
  misc_feature (51)..(51): n is a, c, g, or t
  misc_feature (56)..(56): n is a, c, g, or t
  misc_feature (106)..(106): n is a, c, g, or t
  misc_feature (138)..(138): n is a, c, g, or t
  misc_feature (154)..(154): n is a, c, g, or t
  misc_feature (177)..(177): n is a, c, g, or t
  misc_feature (197)..(197): n is a, c, g, or t
  misc_feature (261)..(261): n is a, c, g, or t
  misc_feature (284)..(284): n is a, c, g, or t
  misc_feature (394)..(394): n is a, c, g, or t
tgttcatgtcagtgagtcattctcatttcagagcctccaaaaagaagtccncactnggaaaagcaggtctgatctaggtgctgccctgaatgccctgtctggctgngcctgaggatctccttcccctgccctgctgcncaagcttgggatggangttataggtaaacgaagtgacangtggccactttccaagccangcagccaggagacagagcgcaggccagaaagtctcagctgctgctgtgggagagccctgctcancttgtaactacaacaaggctgangagagagggttagcagagccagcagggctgtcctcacccgcgctggggctgtactggtggcccgactccgggaaggatgagtgatcctatggccagaccggtcccttcangcaccgggtctaagtactgattcatacataggacctcttcagaagaattgcttcc

SEQ ID NO: 10866 - DNA, 262 bp, Canis familiaris
gcgagttcgaccagctgcgagacttccccatctttgagagcaactttgtgcaggtgacccggttaggagaagtcgccaacaaagtcaccatgggggtggcagcctccagtccagccctggaactcccagatctgttgctgctggccgggcctgccaaggataatggacgcctgcagctctttgggctgttccctttgcagttcgtccagctcttcgtccacgatgaaagccgctggcagcttaaggtcaagttccgcaccgg

SEQ ID NO: 10867 - DNA, 249 bp, Canis familiaris
agcaagaccttctgcgggtcggcggcgtacgcggcccccgaggtgctgcagggcatcccctaccagcccaaggtgtatgacatctggagcctgggcgtgatcctctacatcatggtctgtggctccatgccctacgacgactccgacatcaagaagatgctgcgcatccagaaggagcaccgcgtggacttcccccgctccaagaacctgacgggcgagtgcaaggacctcatctaccgcatgctacag

SEQ ID NO: 10868 - DNA, 366 bp, Canis familiaris
ataaatggcctcttctttgcctttggtgctggggaaaggctgatctggcatcaccagaactttccagggaaacttaactgtcactagtctaccccactgaattgagaggttagttgtgattgctgaaccgagaggaacaaggatatatcaccaggcatatactatttcacagctgtaccatctcattacaacctgaccaggaaactacggtgacgtcaaatcggtgattattagaaccatgctttaaaatttctgggatcccaaattgtctggctagcaggtactgaagagggtaatctgagtggtcaggcctggagaaaatcttccatgaaattgctgaagaaatggctcttccaaagctaagtg

SEQ ID NO: 10869 - DNA, 68 bp, Canis familiaris
gtaaacatctgaaggctatagacatctctgcatctttgtacctgcaagtgccatctttaaggggaaaa

SEQ ID NO: 10870 - DNA, 114 bp, Canis familiaris
ttctggattctgcatatttcagacttcaggaatcgttctttaatctcccacaacttctttttccggaaaatgtaatgcagaataaagataatgccctcgtggaattggatcaca

SEQ ID NO: 10871 - DNA, 480 bp, Canis familiaris
ggccttggtggaatgttgttctcaagatttggacgttcatctacatcacagccatctgagacatcaaaagactcaatagaagacgagaagaagtctgttgcctcgcttcccaccaccactgttgcaacacagacccttccacacagcagttctggctttctggattctgcatatttcagacttcaggaatcgttctttaatctcccacaacttctttttccggaaaatgtaatgcagaataaagataatgccctcgtggaattggatcacagaattgattttgaactcagagaaggacttgtggaaagccgctactggtcagctgtcacatcgcatactgcctattggtcatccttggatgttgccctctttcttttaaccttcatgtacaaacatgagcacgatagtaatgcaaaacccaatttagatccaatctgaactctcgaaggacattaatggcccaaaactgatttatttctg

SEQ ID NO: 10872 - DNA, 387 bp, Canis familiaris
atcagacgaagagcctattgaagatgaacagactccaattcagatatcctggctacccctgtcacaagtgaattgttctcagtttcttggtttatgtgctcttccaggttgtaaatttaaaaatgttagaagaaatatccaaaaagatacagaagaactaaaaagctatggtatacaagacatatttgttttctgcaccagaggagaactgtcaaaatacagagtcccaaaccttttggacctctaccatcagtacggaattatcactcatcatcatccaatcccagatggagggactcctgacatagccagctgctgtgaaataatggaggaacttgcaatctgccttaaaaataaccgaaaaaccttaatacactgttatggagg

SEQ ID NO: 10873 - DNA, 554 bp, Canis familiaris
atccaggctgtgtggcgaggcttcctcactcgccggcccgagactcagcaaaccatgctcccggccatgtggtgcaaaatgggcagcaggaccaggtcaggatccgaccaccgctgtttccagtcgtgccagccacacatctgcgccctctgccagtcgctgagtcccaggctggggagcccgcccagcgtggtgatgctcgtgggttccagcccccgcacgtgccacatgtgtggccacacgctgcccactcgggtggtgcacggcatgggccggggctccacagtccaggctggcttgccgtggggctgcgccacccagatgaattcccggagcccccggctgtcccgtcgccggattaaggcggccacggccatccagtcggcctggagaggcttcagcgtacgccgccgtctgaagcagcaacagatggcagccaagatgcttcaagccacctggcgcggccatcgcacccgggcctccctcactacggatgcgctcttggggccggaagcgtgggacagctcgcagcacatgcagtggccaggtgtcta

SEQ ID NO: 10874 - DNA, 465 bp, Canis familiaris
  misc_feature (206)..(206): n is a, c, g, or t
aattgacagacttagcagaccaggctggaagcgcggttcactgacccccaggacaaccacttttccttgccccggctgtgagcatgatgtggatcttggagaacgaggaatcaatggtctgtttcgaaatttcactttggaaaccattgtcgagaggtaccggcaggcagccagggcagccacagctatcatgtgtgacctttgtnagccaccaccccaggagtccacaaaaagttgcatggactgtagcgcgagctactgcaacgagtgcttcaaaatttaccacccgtggggtactgtgaaagctcagcatgagtatgtgggtccgacgactaattttaggcccaagattttaatgtgcccagaacatgaaacggagagaataaacatgtactgtgaattatgtcggaggccagtttgtcatctctgtaagttgggcggtaatcattccaatcaccgggtaac

SEQ ID NO: 10875 - DNA, 277 bp, Canis familiaris
agcttcctgtgactgaacctgacatcaacaacaggctggagtccttgtgcctcagtatgaccgagcacgccctgggagacggggttgaccggacctccacaatctagaagctgaagatgagagtgaccgcgctggccgtgaaatcgactgctgcgggtccagtgtcagccatcttcagggttgcacagaatcctcggagatgctttgcagcctttttttccccctggtccctctcccattttgattttgtgagagcgtaggtcgtccttgtaaacat

SEQ ID NO: 10876 - DNA, 110 bp, Canis familiaris
gggtctgagggaagcacttgccctcacaacccacccctgtggcatggaaatggaactgggacctcagaggaaaagcactgtggttggcatcatcttctcggctaagcaag

SEQ ID NO: 10877 - DNA, 371 bp, Canis familiaris
gctctttcttggatcagggccaggaagcagaccaatccagacagcagacagtacttaccaaatggccactgtctgatttgagtgtgattgatcaactgttcaaggaaatgtcctattgtttgtttgacttgaaggcattgtgtagtattctcaatcagcgtgctcagggcaaagagcctaatctttcattattactgggaatcagatcaatgaactgttcagctgaagagactgagaatgattatagcccagaaacactcactaaaaaattgtcagatgtatgccagttacggagggacatcgatgaattaaggactacaatatcagaccgctatgctcaggacatgggagacaactgcattacccagtga

SEQ ID NO: 10878 - DNA, 525 bp, Canis familiaris
  misc_feature (278)..(278): n is a, c, g, or t
tatgccccggtcatctcagccgagaaggcctaccacgagcagctgtccgtggccgagatcaccaatgcctgcttcgagccggccaaccagatggtcaagtgtgaccctcggcacggcaagtacatggcctgctgcatgttgtacaggggggacgtggtcccgaaagatgtcaacgcggccatcgccaccatcaagaccaagcgcaccatccagtttgtggattggtgcccgactggatttaaggtgggcatcaactaccagccccccactgtcgtccntgggggtgacctggccaaggtgcagcgggccgtgtgcatgctgagcaacactaccgccatcgccgaggcctgggcccgcctggaccataagtttgacctcatgtatgcaaagcgagcctttgtgcactggtatgtgggggaaggcatggaggaaggggagttctccgaggcccgggaggacctggcagccctggagaaagattatgaagaggtgggcgtggattccgtggaagcagaggctgaagaa

SEQ ID NO: 10879 - DNA, 376 bp, Canis familiaris
  misc_feature (223)..(223): n is a, c, g, or t
  misc_feature (253)..(253): n is a, c, g, or t
gcctcccagtagcagttccaacagggccacagaacaaggcggtccgcaaaacctcggcagcagacaacagtgaaccgggcacgcaggaagaagaccgctacaggctgatgctcagtcggagcgacagtgaaaacattgccagtaactacttccggtccaagcgagccagccagatcctcagcacggatcccatgaagagcctcacgcgtcacagctcgccgcntggcctcagctcccccctcggcagcacctnggccatctcgcccacccaggccccagaaatgccccagccccggcccttccgcctcgagtccctcgacgtccccttcaccaaggccaagcggaagaaaagcagaagcagcttcggcagcagcga

SEQ ID NO: 10880 - DNA, 137 bp, Canis familiaris
  misc_feature (69)..(69): n is a, c, g, or t
  misc_feature (72)..(72): n is a, c, g, or t
  misc_feature (75)..(75): n is a, c, g, or t
  misc_feature (101)..(101): n is a, c, g, or t
gggttctcatgtatcagccatcttctgtaagggtgcccagtgtgacttcggttgatcctgctgctattncgnctncattaacagactactcagtaccattncaccacacgccaatatcaagcatgtcatcagatttg

SEQ ID NO: 10881 - DNA, 337 bp, Canis familiaris
tctcccagaggaagatcaccattgttggaactggtgctgtgggcatggcctgtgctatctgtatcttactgaaggatttggcggatgaacttgcgctcgttgatgttgcagtggacaaactgaagggagaaacgatggatcttcagcatggcagtcttttctttaatacttcaaagattacctctggaaaagattatagtgtatctgcaaactccaaattagttattgtcacagcaggtgcacggcaacaggagggagaaagtcgccttgccctggtgcaacgtaatgtgaacatcatgaaatcaatcattcctgccatagtccaacatagtcctga

SEQ ID NO: 10882 - DNA, 542 bp, Canis familiaris
  misc_feature (310)..(310): n is a, c, g, or t
gggagaagcccacagttaacttggaggccacagccaatcagaaaaaaacagagtcaaactcaaccccaaagcctgagagtggagggaaattaaccaagcaagctgctgagggcaaaccaagacccagacctggagacctgattgagatttttcgaattggctatgagcactgggccatctatgtggaagatgactgcgtggtccatctggctcccccgagtgaggagtttgaggccggcagcatcacttctgtcttcagcaaccgggctgtcgtgaaatacagtcggctggaggatgtgctgcatggctnttcctggaagatcaacaacaagctggatgggacgtacctgcccctgcctgtggacaagattatccagcggaccaaaaagatgatcaacaagatagtacagtacagcctgattgaagggaactgtgaacactttgtcaatgacctcagatacggtgtggccaggagccagcaggtagagcacgccctgatggaaggagctaaggctgcaggagcagtcatctcagccgtagtg

SEQ ID NO: 10883 - DNA, 332 bp, Canis familiaris
attacccgccaggaattatgttggaatatgaaaagagtggagaattgaagaccaaatccatagatttgctcaacctcagtcccagcactgaagtcaatgccctagtagaagaaatacagaaagcagagcctctaatcacagcttcaagatcagagcaagtaaagcttttaattcagagattacaggataaactcagacagcacagcaaccacacattctatctttttaaggttctcagagcacacatactgccattgactaatgttgcacttaataaatcgggctcttgctttatcacaggaagctatgatcggacgtgtaaactctgggac

SEQ ID NO: 10884 - DNA, 459 bp, Canis familiaris
tcagctgtgccaagactgggtactcggccacagtgatattccacacgaagcctttttacggagggaaagtccacagggtcacagcagaagtgaaacacaacccaaccaacaccattgtttgcaaagcccacggggagtggaacggtactttagagttcacatacaacagcggagagaccagggtcatcgacacaaccacgctgccagtgtaccccaagaagatcagacctctggagaagcaggggcccatggagtccaggaacctctggcaggaagtgaccagatacctgcggctgggggacattgatgctgccaccgagcagaagcggcgcctggaggagaagcagcgggtggaggaacgaaaacgggagaacctgcacacgccatggcagcccaagtattttatccaggagggtgatggctgggtatacttcaatcctctttggaaggcacactgat

SEQ ID NO: 10885 - DNA, 537 bp, Canis familiaris
gaaaggctcccttcagaatatttgaaactggaagtatgaagagtttagttcgccagcttaacctttatggatttagtaaaatgcgacagaattttcaaagatctgcttctctggctgactttctagcagaggaaaaagaagcctctgttttaagcaagttacagttctatcataatccaaattttaaacaaggctgcccccaacttttagtaagaatgaaaagaagagtcgggattaaaaatgcttctacagtatcattagtacaagatttcaacaagaaaccctgcagtgcagaaggtaatgtggatagtcctaattttggtttggttggtgaaactagtggagaaagggtatattcaaactccaccaatttaaatgtgcctctaataaggaagccttctaacagtcagagaattgctactacaactgaccccatgaaaagtgatttttctcctacatcaccaatgtcagttagaccatcagaacaaattggaatggagcaacatgctgttttaaaccaattgaccactttccaca

SEQ ID NO: 10886 - DNA, 396 bp, Canis familiaris
agcctggctgtgagacctcttcggaggaatgcctgggcactaaagagcccagggaagccgaaccagagaccccgaagaggaagaagccaaggcgtcaatgccaccgtcgctgccggcgcagccgctcagacagtttcgccatctacttccccagggttctgaagcaggttgacgagggtctgagcctctcacagaaggctgtgagcatcatggattcgttcgttaaggacatcttcgagcgcatcgctgacgaggcctctcgcctggcccgctccaccaagcgctccaccatcacctccagggagatccagaccgccgtacgcctgctgctgccgggggagattggcaagtacgcggtgtctgaggccaccaaggccctcatgaggtacaccttta

SEQ ID NO: 10887 - DNA, 96 bp, Canis familiaris
atcacacagctgtttgaagggcagctcaactacagcatcatgtgtttgaagtgtgagaactgtacttacaagaatgaagtcttcaccgtcctctct

SEQ ID NO: 10888 - DNA, 533 bp, Canis familiaris
  misc_feature (455)..(455): n is a, c, g, or t
  misc_feature (483)..(483): n is a, c, g, or t
tgccgtcagacacacaaactcgagccacttctaagagcctcttacctgttaaatccaaagaagtggatgcttccagatttcattcaggaggttcagaaaatgatgttacaaaaatcgtcaagccaagacgagagaatggctacaaaccgctgagtaagcagaaatcagaggaagagctcaaggataagaatcagctcttagaggccgtcaacaagcagctacaccagaagttgactgaaactcagggagaactgaaagacctgactcaaaaggtggagctgctggagaagtttcaggataactgtttggcaattttggagagcaagggcctcaacccagttttaggcagtgagacctcagcatcacagcaagaagccaccacggatcatacagactctatgttgctgttagaaacattgcaagatgagctgaagctttttaatgaaacagccaanaagcagatggaggagttacaggccttanaagtaaagttgaagattaaagaagaagagagggcccggttcctagaacag

SEQ ID NO: 10889 - DNA, 233 bp, Canis familiaris
agacgagagaatggctacaaaccgctgagtaagcagaaatcagaggaagagctcaaggataagaatcagctcttagaggccgtcaacaagcagctacaccagaagttgactgaaactcagggagaactgaaagacctgactcaaaaggtggagctgctggagaagtttcaggataactgtttggcaattttggagagcaagggcctcaacccagttttaggcagtgagacctc

SEQ ID NO: 10890 - DNA, 512 bp, Canis familiaris
  misc_feature (236)..(238): n is a, c, g, or t
  misc_feature (241)..(242): n is a, c, g, or t
  misc_feature (244)..(244): n is a, c, g, or t
gacagttcagggtggagttctagtaaagataaggatgcgtacagcagttttggatctcgtagtgattcaagagggaagtctagtttctttagtgatcgtggcagtggatcaaggggaaggtttgatgatcgtggccggagtgactatgacggcattggcagccgtggtgatagaagtggctttggaaaatttgaacggggtggaaatagtcgctggtgtgacaaatcagacgaagnnnacnngncaaaaccgctcccaccgagtgaacgcttggaacaggaactcttttcgggaggaaacactgggattaactttgagaaatacgacgacattccagttgaggcaacgggcaacaattgtcctccacatattgaaagttttagcgatgttgagatgggagaaattattatgggaaacattgagcttactcgttatactcgcccaactccagtgcaaaagcatgctattcctattatcaaagagaaaagagacttgatggcttgtgcccaaac

SEQ ID NO: 10891 - DNA, 159 bp, Canis familiaris
  misc_feature (34)..(34): n is a, c, g, or t
  misc_feature (73)..(73): n is a, c, g, or t
  misc_feature (130)..(130): n is a, c, g, or t
ataacttctccatgagagaccataaggaggcttncagccacagcaaaggggtttcctgggttagggttggtgncctggctgttatctgggaattgcaagctttcttaagaaatctctattttattacagntatccttctttgtgggattgcagtgggct

SEQ ID NO: 10892 - DNA, 113 bp, Canis familiaris
ggaaaatgtacacagtgatgttaaaaaaccttttgacaacgagaataactttaacttccttgatctgagagctaattatacaacagaggagattgtagtgtcttcgaaaggag

SEQ ID NO: 10893 - DNA, 395 bp, Canis familiaris
  misc_feature (48)..(48): n is a, c, g, or t
  misc_feature (84)..(84): n is a, c, g, or t
  misc_feature (86)..(86): n is a, c, g, or t
  misc_feature (110)..(110): n is a, c, g, or t
  misc_feature (115)..(115): n is a, c, g, or t
  misc_feature (192)..(192): n is a, c, g, or t
aatatggctgcatgtcagaatcagaaaatcaaatccaaccacaatcancactgaaagcccttcagcatcaactggaatcatttnangctcttcgaatacagactttgcanaatgntagcatggtacagtctgaaatcagtgaaatcttgaacaaaagcattattgatgtagaaaacccacaatttagctcanaaaaaaatctagtattcggcacacacattgaaaaagctttgcccataaagaatcaagaaggaatcctttctatggagaaaattcatcattttgaggagtctaatactactcattcaacagaagaaaaattcagcagtgatatctctcaaggtattgatattccatcccagatacatttcaaggacctattaactcagagaact

SEQ ID NO: 10894 - DNA, 569 bp, Canis familiaris
agcaagtgctcaagacagccctggtgtcaggcgtcatccaggccctgcccgtgccagggctggcggccgcctacgacgacgctctgctcatccgctcgctgcgtggctaccaccgcagcttcggcctggatgacgactcgctggccaagctggctgagcaggtgggcaagcaggcaggtgacctgcgctccgtcatccgatccccgctggccaacgaggtctcgccggaaaccgtcctgcggctctactcacagtcatctgacggtgccatgcgggtggcccgtgcctttgagaaggggatccctgtgtttggcacgctggtggccgggggcatcagctttggcaccgtctataccatgctccagggctgcctcaatgaaatggccgaagacgcccagcgggtccgcatcaaggccctggaggaggacgagccccagtctgaggtcagcctggaggcagccggtgacaatggtgtggaaaagcggggatctggggagggaggctgtgaggaagcaccgctctcggctcgccggaagcttggcctcctcctcaagtatattctcgacagc

SEQ ID NO: 10895 - DNA, 461 bp, Canis familiaris
gtcttcgtggccctctttgattatgaccctctggtgatgtctgccaaccccgaggttgcagaggacgagctggccttccagaaagggcagttgctgagagtgtggggctctcaggacccttgtggcttctaccacggtgaatgcaatgggcaagtgggcaacatacctggccacctggtggccgaggtgaaggtgggcacagagcagactgatgggagatggcatttgccagtgcaagagtacctgccacctgtggcccacctcgacgactttggggagctcaccagcccccagggctcctttcctataccccaagggaacccgaggatgtcaccactgtggactccaacaactatgatggcggctttggactatgaccccaaggatgggtgtgcagggggcagggtgaagggcaagctgtcactgagggcaggggatgtggtcacggtctacgggcctgt

SEQ ID NO: 10896 - DNA, 142 bp, Canis familiaris
accatctacatcgacgaggtgctctgcacccacatgaggaagtccatccccctgcgggatgggggcgaccaaggccagtgggccaggtgcgccccgacaccatctgctgaggatggcacttcacacactgattaaaccctgg

SEQ ID NO: 10897 - DNA, 494 bp, Canis familiaris
agaaacaactccctggcgctgaaggccctggtggaccggatcctgtcccagacagctgacgacctgcgcaggcagtgtgacatggtggacacggcattccagatggggctgaaggagaccaaggccgccagggaccagctggctgcccacctggccaaggtcatggaagagatcgcatgccaggagaagaacatgacggttctggagaaggccatccttgatcaagaggggcctgccaaggtggctcacacgcgcctggagacccgaacacgcaggcccaacgtagagctgtgccgcgatgtcgcacagtaccggctggtcaaggaagtcggcgagattgcccagaatgtcggaaggctgaaggaggccctggcacaggcgcaggtggagctgaagggcctgaaccgccggcaactggcgctgcaggaggaagtccaggtcaaggagaacaccatctacatcgacgaggtgctctgcacccacatgaggaagtc

SEQ ID NO: 10898 - DNA, 524 bp, Canis familiaris
tgtgagaacaatgctggcaccctctggaccatgaacatcaagtgccacatccacgacccccatgggcaggtcatctggggcatgtcctgggccaagctggccaggcacgcctccaacctcaaggtcaacttcttcttcgagcgagtcatgaagtatgagcgcctggcacggatcctcttgcaggagatccccatccggagcatcagtctgaggagctgctactttagcgacccagactggtccatgaggcccacgctgacagatctcctgcccaccttccggaacactctgcagaaactaacatttgagttcaataacaaccacgagtcgctggacgaggagctgcacctcctggtcttgtcctgtcgaaagctgttctacttcaagatctgggcttttcttgacgtcaagtttgtggagcggatcctgaagagtcaggaggaagggcagtgctccctgcgcactctcaaggtgagaatttacacaaaccgatacgagacaaatgacgaggacaggacgctgcg

SEQ ID NO: 10899 - DNA, 328 bp, Canis familiaris
gttgctaaccagctagatggccacatgaatgggcaaatggtagaacatctaatggactcagtgatgaagttatgtctcattattgccaagtcctgtgactctcccttggcagagctaggagatgataagtctggagatgcgagcaggccaacttcagccttcccagatagtttatatgagtgtttaccagtcaagggcacagggacagcagaaacgctcctgcagaatgcctatcaagctatccataatgaactgagaggtatatcaggacagccccctgaaggatgtacagcacccaaagtgatcgtcagcaatcatagcctaagtg

SEQ ID NO: 10900 - DNA, 430 bp, Canis familiaris
  misc_feature (357)..(357): n is a, c, g, or t
tccccgatcttgaggcgtttcaggtgtataataatatagtgaatgagtaattgcataaagtactcattgctcatcaagtatggaacctcaaggtctttgtgataatggaaaccaaaaaattgattggtaaaccgcttcaaccagcaagacctgttcgtcatctgacttctccccctggagcagtgttccctttcaactttcaaaatgaatattcatgcaacactcaatgcttacaaagtggagttagcagatgtaagacgaatggaatgcaagcctttactcaaggtcataatgaacaacagcaacatcagtctccagttaaaaaagagagaattaagtacagcagagatttcctgntgaagctctcaagtgtttccatctgcagaaaaaagccagacttcctgcccgatcatcccattgtacttcaaaa

SEQ ID NO: 10901 - DNA, 234 bp, Canis familiaris
atgtcacttagtgttctgagtaggaaagagaaagaaagagtaattcgcagactgttaatacaagctcctccaggggaatttgtaaatgcttttgatgatctctgtctgcttatccgtgatgaaaaactcatgcaccatcaaggtgagtgtgcaggccaccaacactgccaaaaatactctgtaccactctgcatcgatggaaatccagtactcttatctcaccacaacgtagtg

SEQ ID NO: 10902 - DNA, 49 bp, Canis familiaris
aatttcagaagccttgcttctgctgcaaccaaacatgtcacttagtgtt

SEQ ID NO: 10903 - DNA, 76 bp, Canis familiaris
gatgttatgattgtgcagttgtcaacaatttctattgtgccacaactagggcgtgtgaggaggatcggaggcgctg

SEQ ID NO: 10904 - DNA, 163 bp, Canis familiaris
aggacctccggaggcccaagatccacggggcagcccgggtaccccagtaccagccgcccacactggcctacctccagcgcttgctgtgggtccgtcgggctcccatgctgagccacgtcaatgaagtctggcccaacctcttcctaggagatgcgtacacagc

SEQ ID NO: 10905 - DNA, 330 bp, Canis familiaris
  misc_feature (78)..(78): n is a, c, g, or t
agatgcgtacacagcccgggacaagagcaagctgacccagctgggcatcacccatgttgtgaatgtggctgcaggcanatttcaagtggacacaggtgccaagttttaccgtggaatgcccttggagtactatggcattgaggctgatgacaaccccttctttgacctcagtgtctactttctacccattgctcgatacatccgaactgccctcagtgttccccaaggccgtgtgctggtacactgtgctatgggggtgagccgctccgctacagttgtcctggctttcctcatgatctgcgagaacatgacactggtggaggccatcca

SEQ ID NO: 10906 - DNA, 543 bp, Canis familiaris
tcagcatccttctgtgaccagtcaggatcctcttgtggcccctactgctcccaagcttgtggtcataacccagggccggctgagccgggagcaccggggtcttttcaaccatgaggtgaaatctctggacgtggctcggctgcttagaggtgggcccctggaaccaggcaccccgtcaccccctgccaaaccctccccaagcccaagcccggtgcaagaaccagctctacagtcaagaggcaaggagaaccaggtccctagaggctcaggcccaggtctgcccagttccagtcccgcagagctccctggcttggggcagctgttggaggagctgcagtgccagctgattctgccacaggccttccccaggaggaacctagtgcaagaagccagggatgccattgtgagcaccttacaggcctgccatggctgtgtgcctgacctcaccctggtgctccgtggctgccagccgcccttaccaggtgagcctacctgtactccctgtactccccttccccttgtctgctctagcttcctgtatgc

SEQ ID NO: 10907 - DNA, 190 bp, Canis familiaris
aatgcaactgcaattaaatactccagttatatttaagtatttaacatttaaagatgagataatgagccttcattagatctagattgaatctcgtatcagttgaatttcagcaaagattaaggatgtcaggattgtgctcttggttatttcaaactctttaaatggaagcctgttgctacagtgtgcagaa

SEQ ID NO: 10908 - DNA, 446 bp, Canis familiaris
  misc_feature (269)..(269): n is a, c, g, or t
atacatccaagaaagagtttacgtttgcaaagtctagctcagtctactactgtagaaatagttcctgttcaagttccacaacaaaccccagcatcaccagcaaaagataaagtagtatctacctcagaagatgtaagattaaaaaaagccagtgactcctcaggtaaacgaaggccaatagtaacccctggtgtaacaggattgagaaatttgggaaatacttgctatatgaattctgttcttcaagtgttgagtcatttacttatttntcggcaatgttttttaaaacttgatctgaaccgatggctggctgtgacagctggtgataagacaaggtcaccttataagcatccaccaatcacagatgcagtatatcaaatgaatgaatgccaagaaaaagatacatgcagtgctctctccagacatccaagtttatccttaggact

SEQ ID NO: 10909 - DNA, 398 bp, Canis familiaris
  misc_feature (30)..(30): n is a, c, g, or t
  misc_feature (283)..(291): n is a, c, g, or t
atatgggacattctgcctaccaggtctcantttgtgcttttaacaaaggaaaacttaaagtcttggctaccacctttgatccatatttgggtggcaggaactttgatgaggctttattagactacttctgtgaggagttcaagaccaaatataagataaatgtgaaagaaaattctcgggctttgccgcgtttatatcaggaatgtgaaaaactgaagaagctaatgagcgcaaatgcatcagatcttccactgaacattgagtgttttatgaatgaccttgnnnnnnnnngtaaaatgaacagagctcaatttgaacaattgtgtgcttccctattcaccaggatcgagccaccattaaaagcagtaatggaacaagctaacttgcaacgtgaagac

SEQ ID NO: 10910 - DNA, 344 bp, Canis familiaris
  misc_feature (263)..(264): n is a, c, g, or t
  misc_feature (268)..(268): n is a, c, g, or t
  misc_feature (275)..(276): n is a, c, g, or t
  misc_feature (282)..(282): n is a, c, g, or t
atccccatcttggactttgtggagcagaaatgcgaagtttttgatgatgaagaagaaagcaaattgacctatacagagattcatcaggaatacaaagaactagttgaaaagctattggaaagctacctcaaagaaattggaattaatgaagatcaatttcaagaagcatgtacttctcctcttgcaaagacccgtacatcacaggccattttgcaacctgtgttggcagcagaagattttactatctttaaagcaatgatggnnccanaaaaacnntgaaantgcagctgcaagccattcgaataattcaagagagaaatggtgtattacctgactgcttaaca

SEQ ID NO: 10911 - DNA, 499 bp, Canis familiaris
caatatctcttgactcttgggttcaaaaacaaagaagatgggaaatttttggaaaaactatcaagtaggaagatccctacatttacagaacataaaactcccttcagtctgctgaccaaagaagacacagtgagacacatggagacaatggggaagcgaatcttgccaatattggattttattagaagcacccaattgaatgggagtttccacgggtgctcaggtgtgatggagaagttgcaatatgccagcctcctcagccagctgcagagagtaaaggagcagtcccaggtgatcaatcaagcaatggcagagctagcaaccattccgtatctacaggacgtcagtcaacaggaggcagaattgctgcagtcactaatggcagatgccatggacacccttgaaggaagaagaaacgataaagaacgtgtgtggaatacaatccaaaaggttggacgaattgaggacttcctataccaattagaggacagtttcttaa

SEQ ID NO: 10912 - DNA, 377 bp, Canis familiaris
aatccagatgaagtttctcttactaatgagtctttatctgattggatatgccagaggagcatcaggtcagcctgatgagcctcctggctctatggatcatcaagcttcagttcagcaactttcaggtgagtacttttcacttggaaacccatcagatggtgaggctttatatgagactgctgcaggtgagaacactttaagtgagcacacttcaggtgagcatacttccgttgagcacttttcagctgaacattcttcaactgagcatacttcaggtgagcacacttcaggtgaacacacttcaggtgaacgtgctacgggtgaacacacctctagtgaacatgctacaagtgagcacacttctggtgaacagcctt

SEQ ID NO: 10913 - DNA, 398 bp, Canis familiaris
gaaggtatttccatctgtcagcagcacttaatttggaataacatggaacttgaagatgaattttgcttgaatgattacaatatatcagaaggttgtaccttgaagctggtattggctatgcgtgggggacctataaatactagaagagttcctatggaagatccacttagggagatggctgagtacatggattccattcgagatgaggtctgggagaagacctcctgcaacaaacaagttacatttttggtataccgagaaggagatcaactgaatttctttcgtgtagtagataggggagatggcactttaacaccattatctgaatctttaagtggtggttctgtgtataatttgtatacggatgaggatgaagaaattgagccttctccttctgg

SEQ ID NO: 10914 - DNA, 38 bp, Canis familiaris
gcaaaaaggtgaagctgtcggcatttggccaggctttt

SEQ ID NO: 10915 - DNA, 431 bp, Canis familiaris
tgagtgaccgcttcagcggcgagatccccgatgaccagatggcacatagctccttttttccagatgaatacttcacctgctcctccttgtgtctcagctgtggggctggatgtaagaacagcatgaatcatggaaaagaaggagtccctcatgaagccaagagccgctgcagatactcccaccagtatgacaacagagtgtatacctgcaaggcctgctatgagagaggcaaggaggtcagcgtagtgcccaagacatctgcttccactgactccccctggatgggtctcgcaaaatatgcctggtctgggtatgtgatcgagtgtcctaactgtggcgtggtctaccgtagccggcagtactggtttgggaaccaggatcctgtggatacggtggttcggacggagatcgtgcatgtgtggcctggaact

SEQ ID NO: 10916 - DNA, 178 bp, Canis familiaris
aggcaccacaaatcaaccatccagaaagaaaactcgtcttttcacatcattcaacctagagtcctgcctaatttcacctgtgactcagtttaggcaagttatcaactacagaacagccaatgtcttaatggaaattaaaaaacagaccttcaaaaatgctaggtttacaatgagaggt

SEQ ID NO: 10917 - DNA, 430 bp, Canis familiaris
ataattcctggcaactacaccaaggatggccccaggaaatccgaaatcaacatcaaggacgccatcgccctggagtccacgcagcggcccctgtcctaccgccaccaaagcatcgccgactccctgctgcaggagccgtcagccttcagcgctcggaagtccaccctcctgagagactgggtaatgagcaggacgtccgacgtgtcctacgagcgcaagctgaggagcctcatggagaagggcgcggagcccaaggccgaggcggtgaggatgctgaagcccgaggaggtgctgagctgccgatacctgaggttgtccaagaacaacattcgaaccttgctcaagctgtgcaaggatgcaggcatgaatgtggacatccatccccacatggtcgaaggagagatagatgccaaaaaggtgttcgccccaa

SEQ ID NO: 10918 - DNA, 124 bp, Canis familiaris
agcatagccctctaagcagcttgtctccccggccacctcagggtccctctgtgttgggccctcgccccccacacaacatcctctggtatggcacaccaagtccttcaaacctggtgcatccctt

SEQ ID NO: 10919 - DNA, 523 bp, Canis familiaris
aatcagagtcacaccgagaatcgccacggggccatcatcccttttggcgaaagtgtcttgacacagtgtcaggatgtggacctctccttcccacggcaaccagagggatgcagtctcttcaatggtacaaaaaggggaacactgtttctcacttcataccgggtgatcttcgtgacttcacatgcagtcaacgaccccatgttttcttttatgatgccatttgagctgatgagtaactgtaccattgaacagccagtttttgctgccaacttcattaaaggaatcattcaggcagctccagatggtggctgggaaggacaggctacttttaaattatccttcagaaaaggaggtgccatcgaatttgcccagttgatgatgaaagctgcttctgctgccgccagaggagttccacttggaagtgtaaattactggttcagcactccaggactgtatgtaattactgggcaggggggttgtgcaccccacagatgccttgtccagcatacccatttgttgtcta

SEQ ID NO: 10920 - DNA, 139 bp, Canis familiaris
cccagatgctcgaggagaattcaaggatcctcaagtttggatatcagtttaccaagcaaggccctcgaacaagggtggcagccgccatcacaaagaataatgacctggttcgtaaaaagcgagtcgaaggagaccgaag

SEQ ID NO: 10921 - DNA, 334 bp, Canis familiaris
  misc_feature (133)..(133): n is a, c, g, or t
  misc_feature (193)..(193): n is a, c, g, or t
  misc_feature (240)..(240): n is a, c, g, or t
agggcccaagagcacgttcccaaatacgcatcgctttcagttagttatttcaaaagcacccagtggggaccttttggataaacattctgaactcttttccaacagacatttgccattcactccacgcactttnaaaacagaagcaaagtctttcctgtcacattatcgatattacacacctgccagaagaaanaaggattttacagatcagcggatggaagctgaaacccagactgaatnaagcagctttaaatctgattttgagacagttgacaccaagaacttcacagattcagaagagaacataaagcaggcatctaactgtttgacagat

SEQ ID NO: 10922 - DNA, 466 bp, Canis familiaris
ggaaacagttacgaccaccacagtggttcttagtgatcacaatttagagatagcacgactacaagaatcaataagactttgggaacaagaggtcaaagaattgaagaaatcctgtaagatactggaggataaaatacaattttttgtaagtaccaaagaaaaactggaagagtcatctggttttgaaaaaggtgaacttttacaaaagataacacagatggctgaaaaactacacaaaaatcgtttggagaacaaagatctacaggggaaactgcatactcttaccagacaatataagattgtcttaagtgaggaggataaactttttatgcagaaacagaaaatttacgtggaaaatcagaaacaactgacatttattactcagaaagaaaacttcctgtcacaaagaaaagtagacgtcaaaaatatggaagaaggacttgtcacgctccatgatcttcttcag

SEQ ID NO: 10923 - DNA, 333 bp, Canis familiaris
cagcgggttggtagcggtctccccagcgggagccaggtggcatcccgctgtcccagcgtggcccttgcccaacagaaccaggtggccacactgcccgtacggctcctgagggacgatgtggtgactgcgcagaacaacttccatgcagagaatggcttccagatgaaggtggatgcctgtggctttgccccggaggagctggtggtgcaagtggacggccaatgtctgatggtgaccggccagaggcaactggagggctgcagcccagatggggctggctaccgtgtggcgcagagggtgcatcggcagatccaactaccaccggacctggat

SEQ ID NO: 10924 - DNA, 216 bp, Canis familiaris
  misc_feature (32)..(33): n is a, c, g, or t
  misc_feature (37)..(39): n is a, c, g, or t
  misc_feature (65)..(65): n is a, c, g, or t
  misc_feature (69)..(69): n is a, c, g, or t
  misc_feature (115)..(116): n is a, c, g, or t
  misc_feature (118)..(118): n is a, c, g, or t
  misc_feature (153)..(153): n is a, c, g, or t
  misc_feature (188)..(188): n is a, c, g, or t
agcaccgctgtgtctgccaggacagtatgtcnnacgnnncacaaagctgccgacagacgaacgtncaanaagttcaaatgtgacaaaggtcacctggtgaaatcagaattacagnnanctagcccctcagagtgaccgtgttgctgtgcccanaataccacccgagagccctggtaacagtgagcctntggggtttgccaaagagcacgcgctgcc

SEQ ID NO: 10925 - DNA, 462 bp, Canis familiaris
ggagcagaatgcaaaccacccacaccggatcgaaatacagaacatctttaaagaagcccaggccctggtgaaagagaagattgtgccgttttatagtgggggcaactgtgtaactgacgaatttgaagaaggcatccaggatatcattctgaggctgacacatgtcaaaaccggggggaagatttctctgcggaaagcacggtaccacaccttaaccaaaatctgtgcggtgcaggagatcatcgaagactgtgtgaaaaagcagccttctctgccactttccgaggacgcgcacccttcagtggccaagatcaactcggtgatgtgtgaggtgaacaaggccagaggcactctgatcgcacttctgatgggggtgaacaataatgagacttgcaggcacttatcttgtgtgctgtcggggctgattgcagatctggatgctctagacgtgtgcgggcgaac

SEQ ID NO: 10926 - DNA, 324 bp, Canis familiaris
  misc_feature (27)..(27): n is a, c, g, or t
  misc_feature (107)..(108): n is a, c, g, or t
gcaaaaacacagtcttctgtttccaangcaccccagcattcaatgcagactccacagaaaactgctgtaatattaccaacacagcagatcaggaaatcaagccgcannaagccacctccacagacttcagtccctacaaagggaagtgctgttaaaaatctcacaccaaggaagaaaggccccaaaaaggaaaaatatattcctgttttgtgttctacatcttcagcttctataaattccctgaccagagaccgtcgtgcttcatataaggatgttactcctggcacatctaaaatagtgatgtcaacagtgtgtgtctatgta

SEQ ID NO: 10927 - DNA, 550 bp, Canis familiaris
tagcctgtggcgcaaacgttaactgtgccatctcctccacagggaatacagccctcaagctggcagtgtgcaccgcatccagcaaagccggccgactgctggcagcaggggtgagctgcatccgtttgctgctaattcatggagccaaagtaaatgcccgggaccataaaggtcaaacagctatccatgaggcatgttttggaggcagagaggcaataatcaatctcctgcttgaatttgaagcaaacgttaacatattaacaagaaacggggagtctccgatatacatgtacctccagcgaagttccaacatcagggacacagggcttctcgccaagctattttaccgctcttatcctttaagactaaccaataaccaagggattctacctgcaggaatcatgctgccagaattccacctcttaagggaaaacctaataaagttatctcaaaaacccttatccctagaggacatctgtaaaagaaacatcagaaatatttacggtgagaaatacaaacaacacttaaagcaacttctcccagtgcagat

SEQ ID NO: 10928 - DNA, 393 bp, Canis familiaris
tcagtcaattgaatccggcggcatcgagtatgactggaacttaacatcacttaagaagatggagaagacctctgcagagtccaaggattgggagcaagttgaagatagcaaatcccaggactgggagaaacattttctggatgccagtgcaagcaagccaagtgactggaatagtgagctggatggggactggcaggcacccatgctacagaagcctccataccaggatggcctgaaaccagagggtatagacaaagacatttggctccaccagaagatgaaaaacaccaactatttgacagaatatgacctctccgaatttgagaacattggtgccattggactggagctttggcaggtgagatcaggaaccatcttcgataacttcctgat

SEQ ID NO: 10929 - DNA, 177 bp, Canis familiaris
atggcggcggctctgtccggcctggctgtccgcctttcgcgctcggccgccgcccgctcctatggggtcttctgcaaggggctgactcgcacgctgctcatcttcttcgacctggcctggcggctgcgcatcaacttcccgtacctttacatcgtggcttcgatgatgctcaacgtc

SEQ ID NO: 10930 - DNA, 305 bp, Canis familiaris
  misc_feature (175)..(175): n is a, c, g, or t
  misc_feature (212)..(212): n is a, c, g, or t
cttactatgggaccagtcttggaagggccttctgttggaaatttgactagtagtttactgctggatagaaatgttactccaagagaaaatgtaatgattcctacctcaaggccgcagacttcagttagcaacattgaaactcacttgttcaagatgcagcagatgttggaagacngtataatcagagaactaaaagaagttgctcatgattnagaatcaggattctgtagatcttctcctttaggacctactgacgaatcaaatgtaaatcaagatcatagtactgcaagcatcacgagaatatg

SEQ ID NO: 10931 - DNA, 398 bp, Canis familiaris
tcagtgaaccactaccaagccctgtcaatcccagcactaattctaatggcatgaaagatgatccacatgctggaggtagtatgatgatgccacccatcaatctaactagcagtaatttgatggcttcaaatcccaattcaaatctttcccatccaaattcaaggttgactgaaagagcaaaaaagagacgtacctcttcacaatctattggacaggttatgtctaattacaggcaagaggatgcaggtcccattcaaagccaaatggagaaaagtgtatttaatgagcgaacaggtcaaagtgaccaaatggcaaatggacacaaaagaaagctgaatttttccagatctgacaggaaggaattccatttcccagaactgcctttcacaatacagccc

SEQ ID NO: 10932 - DNA, 435 bp, Canis familiaris
  misc_feature (46)..(46): n is a, c, g, or t
gtatcacagtaacagggcccaacgtaaaggctgttgctaccgctgnggaacagatctacccatttgtgtttgaaagcaggaaagaaattttataatccatcactcaactggttagaacctaactgagcaccttttaaaacctgccgcacattggactcaaaacaaaaggaaaactggaccaacagtaattgaggatatagactcttatattcattcatggctgcagtgtgagctccaggccctttgggttttatttcagaccttgctgtaatataaaaaggaagtttacaagacatgacattgctgcttttacaaaaggacattctatttattttcgcagtaattctcatgtccccgtaagcagagctgtcacagtgtgcactaccttaaactgtttcgttagtgtcattattttttcccagtttgagctaatgt

SEQ ID NO: 10933 - DNA, 438 bp, Canis familiaris
  misc_feature (33)..(35): n is a, c, g, or t
  misc_feature (37)..(40): n is a, c, g, or t
  misc_feature (46)..(46): n is a, c, g, or t
  misc_feature (48)..(52): n is a, c, g, or t
  misc_feature (142)..(142): n is a, c, g, or t
gctggaatccagttagactctatgaacagttgnnncnnnnggaagnannnnngcctgatgaacgatggatgagctatgaagaacgacacctgctggatgaactctatataacaaagcgacggctgagagaaatagaagaacnactacatggattgaaggcatcatccatgacacaaacacctgccttaaaatttaaggttgagaatttcttctgcatgggatccccactagcggttttcttggcattgcgtggcatccgcccaggaaatagtggaagtcaagaccatattttgcccagagaaatttgtaaccggttattaaatatttttcatccaacagatccagtggcttatagattagaaccgttaatactgaaacactacagcaacatttcacctgtccagatccactggtataatacttccaatcctctacctt

SEQ ID NO: 10934 - DNA, 131 bp, Canis familiaris
agtacatgagtgactttctctcgatgtttaaaaaccagtacctgtggatgactaggaatactggaagcagcatagtgttgacttaacaaaacaagaccgcttgatcagctacaatcttgttctctctgtct

SEQ ID NO: 10935 - DNA, 453 bp, Canis familiaris
agcactgtttactgtctcgacagcagggtctgacaagtagggtaatggcccgacagctcatgcctgaatggatgaatgtttgataaggctccattacagctgatcccacagcagttactcgcagggctcagtcaccccaatggactgttaggcacctgatagaaatggggaagatgtgcagttttcagggtcagagcacagctgctggtacagcagcttcacacaggtgcccgatgaagaacgagctgacgtcagaaggagaatgctcatcattaggggtccagttctcattgaaacctaggcagcctttcatcaaaatcagacacaagcgaggtcttgtgtcatacatacagaccatgagcgcccccctcccatcagcagcctcctgcagcccacgtcatagtcttcaaaacctgggagcagcctctaaaagcctcctgacttatttgacaa

SEQ ID NO: 10936 - DNA, 79 bp, Canis familiaris
aaacaactgtagatctggtgatccaagacctcagccaacagagcctcctgatcacttaacaattgtcatgggagataat

SEQ ID NO: 10937 - DNA, 146 bp, Canis familiaris
gtctagtgtgaagagaccacccagacatctcatagacttggcaattccacccaagagagaaagtcaacatcagcctcaatttgaccaacaaactctcattcgatatatttgttttcgaagatatttgcagcctgcggaacaatggt

SEQ ID NO: 10938 - DNA, 396 bp, Canis familiaris
gctgccatccgacttcgagaatttattgaccaccgcccagtggtcccatccagtatattcatcactcatcaaggaaaggacatccaaggatattacactgggcagctggcaagagtccatttcgagtctagtgtgaagagaccacccagacatctcatagacttggcaattccacccaagagagaaagtcaacatcagcctcaatttgaccaacaaactctcattcgatatatttgttttcgaagatatttgcagcctgcggaacaatggtataaggaaaccacctatcaaagagactattctctgccattttacaacatgggttgcaaccagaaattagccacagtttcatcaaatcctacaccactaaattcactgccagagttctactgttgt

SEQ ID NO: 10939 - DNA, 552 bp, Canis familiaris
ggcaagatatccagacagctagagaaagacaatgagcagcaaacattattggatattcagcagaatttacagattgctacaactcaaagactagaggataaaattcagaaacttcagaaacagctcagtgatttgaaattgtcaaataaaagtatgaaaactcaacttacaagagtaaatgtccttaaggacaaaacaattgagaagctcaggcaatctttaacacaagttgaagcaatggaagggaaggcagttatgaaagcagagaacttgaaaactacattagactctgccaagcaagaggcaagaggagacaaagagaaagtccaccagatgttaaatgctgtcactcctgagctctgcacagcaaagaacatgcttgataaagtaccaggacaacaagagctttctgattttcgagaaactattatgaagatgttgggatttaatgtgagaacagctgacaagaaaatcatcaatcacctaaggcttgttatacaagattatgaagcatctaagaaatcaaagattgcttctgattgtaagactaga

SEQ ID NO: 10940 - DNA, 556 bp, Canis familiaris
ggagtcgacatatctgcaaaagcaccttgggacatgtctaactcaaggtcttgcagaagtggcaagaattcgcccagtggatccaatagaatatttagcattgtggatttataaatataaggaaaatgtgaccatggagcaactgagacagaaggaaatggctaacttggagcgggaaagagaactagctgagattgagcaggagatgatggagaggctcaaagccgaagaactcctgtttcagcagcaacagctggcattccagctggagctggaaatgcaagaaaaagagagacaaaggatagaagaactacagagagctcaagaacaattagagaaggagatgagaatgaatatggaaaatatagctaagagtgaagatagttcacatgcagaggatgtaacatcagactcaggcaaaacactagctgaaatcagtgaccgatatggggcccctaacctgagcagagtggaagaacttgacgagccaatgctctctgatgttgcattaaacattgatcaagatttgtaggatcaaccaacctaagagcaataa

SEQ ID NO: 10941 - DNA, 99 bp, Canis familiaris
gtgccacaacactctacgggaaggtctacatatgtggtggttttaacggaaatgagtgtctgtttacagcagaagtgtacaacactgagagtaatcagt

SEQ ID NO: 10942 - DNA, 525 bp, Canis familiaris
gcaacctttgcagccatgattggagctggaatactggtacaatcaatatcatatgaccagagcccaggcccaaagcatcttgcttggttactacattctggtgtgatgggtgcagtggtggctccactgacaatattaggggggcctcttctcatcagagctgcgtggtacaccgcaggcattgtgggaggcctctccactgtggccatgtgcgcacccagtgagaaatttctgaacatgggagcacccctgggagtgggtctgggcctcgtctttgtatcctcactagggtcgatgtttctcccacctaccactgtggctggtgccactttgtactcagtggcagtttatggtggattagttctcttcagcatgtttcttctctatgatacgcagaaagtaatcaagcgtgcagaagtaataccagcgtatggagttcaaaaatacgatcccatcaattcgatgctgagaatctacatggatacattaaatatatttatgcgagttgccagtattctagcgact

SEQ ID NO: 10943 - DNA, 374 bp, Canis familiaris
gcttccatgtccaagaagtctgacagaggggaagaacaatgccaggacaatcaagaacttgactttatcagtgggatgaagcaagtgaaccgccaatttatagatcaactggtagaatctgtgatgaagttgtgccttatcatggctaagtatagtaataatggggcagccctcgctgagttggaggaacaagcagccttggcaaacaaccccaattaccaggttggtggctccaggtgtagtcaagatggtgcgatgtcacagaaccatcaggactctcctggacctgaagtcatagttaataatcagtgctcaacaagtagcttgcagaagcagcttcaggctgtcctgcagtggattgcagcctcccaatt

SEQ ID NO: 10944 - DNA, 493 bp, Canis familiaris
tttatagaacaaatggccctgaaggagctagtactccaggctgcgaaagaggaagaggagacctttcgaaaggctatgctcgcaaagcttgctgaagacgatcggatagaactgatgaatgctcagaaacaaagaatgaagcaactagaacacaggagggctgtggaaaaactcattgaagagcgtcgcaaccagttccttgcagacaaacaacgtgaactggaagaatggcagttgcagcaaagacgacaaggatgcattaatgcaattattgaagaagaaagactaaaacttcttaaagaacatgctacaaaattactaggatatctccctaaaggagtatttaaaaaagagggtgatatcgatatgcttggtgaagaatttaggaaagcatatcagaaaaggagtgaaatttgtggagagaaatgataccatcaagatttggtaaaacccgaattgtttttaccactagatgtcaccgtaacttttgttt

SEQ ID NO: 10945 - DNA, 435 bp, Canis familiaris
  misc_feature (149)..(149): n is a, c, g, or t
  misc_feature (311)..(311): n is a, c, g, or t
gattgaagaggcagatctacagccgccagagatgaccacactgaagagtccaaaggaagcccaaagaaagtcgcctgaggagaaaaggacagagcctcttgaagagaccaaatcagaatttcttgaagaaaaatcaagaaaatcaattngaggaaataggtctagggccatcaggaaagaccaaaccagaagttcaggtggagacactgaaagaatcaactgtggagaaagttttagaaccactagaggaaactaaaccatcagagcaaaaagataagcaaagaaaatcaacggaggagacgggactagcnccaccacagatgtccaaatcagaggagactgtaggagagtcaacagaggagaaaggtctagagccaaagtttccaaagatagaaccaagaaaatcaagtgaggaaacagatcaaatgccaccac

SEQ ID NO: 10946 - DNA, 453 bp, Canis familiaris
gcaagagcccgtccaacaaggatatagccctgatggaggctgctcgtgccaacaatgtccaagaagtcagcaggctcttgtcagaaggtgcagatgttaatgcaaggcacagacttggctggacagcacttatggtggcagccatcagccgaaacgacagcgtagtacggatcctgcttgctgctggtgctgacccaaaccttggggatgatttcagcagtgtttataagactgcgaaggagcagggaatccattctttggaagtcctggtcacccgagaggatgacttcaacaaccggctgaacaatcgtgccagcttcaagggctgcacagccctgcactatgctgtcctcgccgatgactatcgcactgtcaaggagctgcttgatggaggagccaaccccctgcagaggaatgaaatgggacacacacccttggattatgcccgagaag

SEQ ID NO: 10947 - DNA, 366 bp, Canis familiaris
  misc_feature (150)..(150): n is a, c, g, or t
  misc_feature (155)..(155): n is a, c, g, or t
gaatctccgaggtgacagacgtgaagaataagctgcagatacagctggctaagacgctgcaggagatcttccaggcggagaataccatcatgcttctggaaaggtccatcatggccaaggagtgcccgctgaaggtggcgcagacgaggntggantgccggacccggcgtcccaatgtggagctgtgcaaggacatcccacaattcaagcttgtgaatgaggtgttcaccattgatgacaccttacagaccctcaggctgagactgcgggagacgcaggacacgctgcagctgctggtaatgaccaagtgccggctggagcacgagctggccatcaaagccaacaccctctgcatcgacaaagaga

SEQ ID NO: 10948 - DNA, 141 bp, Canis familiaris
gtggtcactcatcgttcctaaagaattaaggccgtagaaagcatgtgtggcaatgactgcggtttacttccaagtcagtatgcataaatactgttacactattctaggcaatatccttgtacacattactgaaggcacttt

SEQ ID NO: 10949 - DNA, 432 bp, Canis familiaris
aggagtgtcaccaggtccgactttctccccatgacccaccctcatggggacgagttcctgcctgtgttggccagaggatccgagcgggagacgggctacagccgagtgaatgagaggatgctgaacctcagggtgttgccttcaggcccagaacctagcagcatgagccaccggcagttccagcccccacagcgggtacaacagacaaacattgccctgctgggccgggagaccgtggggaacaaggagcccacggggtacagccttaacaaccccagctacgtccggagcccctatgaccccgacatggacaatcggtacctgagcacctacaaccaagggtactttgagaatatccccaagggtctggaccgagaaggctggactcgaggtggcatccagccgcagaagcctggaggctatgccctcaac

SEQ ID NO: 10950 - DNA, 488 bp, Canis familiaris
  misc_feature (327)..(327): n is a, c, g, or t
acagatcttgccctcgggtataagaactgagcctcccgtgattatcctagcttcttttcttgattctcagcttgtgttctttgattgttcataatctggcctttaaataaaaagggccatcatttcattaatgaaaaaaaagacttcaaagaaatggtggatccacccctctccacctgatttttcccccttggaagaggcagcaataaaaaataccaggatgaagtttggttttctgttctggatccaaggcaagaagattgagaatctttgatgccttacctgggaccttcttcatattggattggactaaagaagctaaatgcnagcacaccctggatgtgggcaaatgaagatgcattcaacaattggttcaaaattgaaggaaatggaacgtgtgccttcatgtttaagaagggcataagcagtaccagctgtgatgatgcaataaaatatatatgcagcagagaagccctttgtctttagat

SEQ ID NO: 10951 - DNA, 475 bp, Canis familiaris
tggacagtcggaacttgcctctcagccggacgttcaccatcaccttcatcttgcttgcctccttcgtcttcctcagtatgtttgtgggtgtaatgatcattcacactgaggactccattaaaaagtttgagcgggagctgatgctggagagacatgtgacactcatggaagagaagcaggtgattgtaaggcggcagcaggaagaggtcagcaagctgatgcagatgcagaaaaacgctgactacaaaagttttagtgagctggtggagaacttcaagaagaccctgcgacacacagaccccatggtcttggatgattttggcaccagcctgcccttcatcgatgtctatttgtccactctggacaaccaggacaccacagtctacaagcttcaggagctgtactacgagattgtacacgtgttgagcctgatgcttgaagacctgccgcagaagaagcagtcccagtcctccga

SEQ ID NO: 10952 - DNA, 527 bp, Canis familiaris
gtgggcacctataccccagaaatggcaagaaacgaggaggccatccaggagcaccaacaactgataagcgatcgagtgtgcgcctcgctggcgcagaagatgcgtgagaccttggagctgaaggaaagaatgaatatgaccttaggactcatgaggggaactatccatcggtgcacgaaattcaaccaggaaatgtacatcactcggggcctcatcaagggtcctctgtcaaaaagtcacctggagactcgagagaaactggatagacctctggttcgggtgtaccagagacacgtgggcacccagctgcccgaagcctcgcgcctcgctcagggtactgacaagctgcagcgccacatctcgcacgtggaaaaaaacctgaaggagctgctcgccacgcacaagaacctcaccgggagcctcaactgcaagaagaccgggtatgaagtggactacaatgtggtgcgcctgcgcctccgccagcggcacccgcacgtgtgctacgagcaggcgcagcgtctggtcaa

SEQ ID NO: 10953 - DNA, 383 bp, Canis familiaris
gggcttcccctgaatatgcttgaaaaacacagcccttggccagcctatgtcacatatatgtctccaatggtgaaaagactcattgagaaaagcaaagctagagacctggaatgcaagcaagcacttgaggaaagccaacggacatcccggcagagcaagccttccagcatcacacacctgaaaaggagaaagtcatctaagtcctctggaaatatggtgttgaaggacacgaggtcagaggccatgttatcgatgtggagctcgtactctgtaccgactgtgggtcctactgttatcccggagccagtgtgccttcatacggattccagagaaaatcccactgcaaactataacaagatcatcttccctcgaaaacctatgat

SEQ ID NO: 10954 - DNA, 486 bp, Canis familiaris
  misc_feature (427)..(427): n is a, c, g, or t
gaagacagaggaagaactcacagaaaacattgggcttcccctgaatatgcttgaaaaacacagcccttggccagcctatgtcacatatatgtctccaatggtgaaaagactcattgagaaaagcaaagctagagacctggaatgcaagcaagcacttgaggaaagccaacggacatcccggcagagcaagccttccagcatcacacacctgaaaaggagaaagtcatctaagtcctctggaaatatggtgttgaaggacacgaggtcagaggccatgttatcgatgtggagctcgtactctgtaccgactgtgggtcctactgttatcccggagccagtgtgccttcatacggattccagagaaaatcccactgcaaactataacaagatcatcttccctcgaaaacctatgatgaggatgcttccngtacagctcccttctagccagcaaggaaaaacattcaaatatctagcagggagtccctg

SEQ ID NO: 10955 - DNA, 178 bp, Canis familiaris
gaatatctacactgatagaaccagttatctccaaacaactgccaaagaatctcaaaaaccaagaaagattcttaggaggatatggtggaaacacttcaaaaagatcataatcatcactgtggtaattctcctttcaatcatcatcattcttttaagtacaaatgtaataccaacctga

SEQ ID NO: 10956 - DNA, 113 bp, Canis familiaris
  misc_feature (64)..(64): n is a, c, g, or t
ccatctgcatttccttacaaatgttagtgatacttttctgagaaatcctttgatgtcgcaagancatttttctccttcaaatgccgttgctgcagattttcaacaagtattag

SEQ ID NO: 10957 - DNA, 520 bp, Canis familiaris
gagatgctaaaacctcttgaagataagaacaatctcttattccagaagttgatgtctaacttggaggaaaaacaaagaagcctgcagatcatgaggcagatcatggcagggaaggggagtgaagaatcctcagtggtggagctcattaaggaagcagaggagatgaagcagaatctggaaaggaaaaacaagatgctttggaaggaaatggagatgctatggaacaagacattcgatacagaagaccttggtgatcaacaaaaagcaccacagataaaaaacaaagcagacttgcaggatgggaaggcaagctctttcttccaccaggaaaagcaacagaggaaaatggaatgggtcaggtaccaggaacaagccaacatccttcagaatgactttaatggcaaagtgattgagctgagaattgaagccttgaagaactaccagaaggccaatgacctgaaattatcactatacttacagcagaatttggaaccaaagcaagcatattttcatcttcctg

SEQ ID NO: 10958 - DNA, 560 bp, Canis familiaris
gcccctgacactgacgacgaggagaagcccccacatcagcactctgcagtctgctcccacaactgggatcaccccacagactgggaaggcttccagtccacaaagggcttctggggcccctggccccaggatgctgtggagcccgctccccagaccattcgcttccagcagaccatagaaggcaggcccctgaaaggcgagatgcagtcagagatgggcctagaggcctatgtgtaccctgtgaatcccccgcccccaagccctcagacgctgagccacaagaacagcggagcggggcccagggcccaagccgagcaggagcaatgcgcccctgcccctcctgccccaccgcctgcccggggcccagcaatcgtccctgacatcccccggtgccgctcctcgggccgtgtagtgtacgatgcccgtgatgtgaggcggcggctccaggagctgacccgagaggtggaggccctgtctcactgttaccccctgggctccagatccagcaatgctgaggagacaggcaaggactgggtgtaccgttccctgacagagaggtg

SEQ ID NO: 10959 - DNA, 587 bp, Canis familiaris
gccagctgctctatgactcctgggaccagcggcggcggggcaccgagggctctgagcctccttctgccctggtgccccggggctcccggcccgaggcccgggagcactgttctccacaggcccacaggcggagcctccccagccatgcgtacagccagctcaaccgcagcccccacccatccaccggccacttgggctacagctcccgggatccccacgaggttcggcgccgagcggctgaatgggcagaggccctacccgctcggcaccccctaacagcctctgcctccctcactatattgggtgagacctcataccaacgggccccagcccccagctcggccctggtcccccactcttcccagcccctgtctgccgaccaggctcccgagcccccccaagcccagcccaccttcatgccgctcagcaggaccccaggcggcaatgcaggctaccaggtgtatgacagcctggagctgaagcgacaggtgcaagagagccgagcgagggccagctctctgcctccaccttccacctcggcctccaggccctccctgcacaggagccggaccgggaagcttcactga

SEQ ID NO: 10960 - DNA, 555 bp, Canis familiaris
agtggaccccacctacttatggattgggcctaatgaaaagccattaacagtaaatgatcgaataaatataactaaaacaggaaagctgaaggtgaaagattttctggaggctttgtctggactttacacgtgtactctttcttataagactgtcagagcagaaacccaagaagaaagtatagtaaagcaaagatatgactttctgatctttgtcaatccttttgcaccagggtggaaaggtgcatgcaaggattctgttgattgtgaagataccactaatcataatatcctccaggcaagagatcggatagaagaatttttccggagccaagcatacatttactaccacgactttaataaaactatacctgctatgcactttgtggaccacagttttcaagtagttcgtttggatagctgtcgtccaggctttggaaaaaatgatggtctacacagtaattgtgctagctgttgcgtggtttgtagtcctgggacttttagtcctgatgttgatgttacttgtcagaactgcgtttccgtccgtatttatggagc

SEQ ID NO: 10961 - DNA, 514 bp, Canis familiaris
atgaagctgtcataccatcggaaagtgaaccagctaaaataacagaaaaagaaaccttgaaacataaaacatttagaacgttttctgtacccttgaagtcagaggaaacagaagacatctatcaagattactatccaggcatgccaaattactttcaaaaaagtagaattcaacaagaatcttcaaaaccagtttctcgtaagaaggaagaaaaaccaaagggaaaaaaggatcaaactcatggttgtccagaatttaagaaaaaaaggcttgtgtcatatgatagaatagaaccagaggatgatgatgtgacaagacatattattagactaagagaaaagtttggttggcagacagtgttaccacagcactatttggagtacagaagcttcaaaattgcaattcagaagattattctaaaggaacctttaaaagatgatggagaatttatatattgccttcctcggaaaaatagtcaagttctctataatccatatgatcttcaggtggtctc

SEQ ID NO: 10962 - DNA, 247 bp, Canis familiaris
gaaaccgccaagacgaaaatgctcgtcatggaggagcgcatacagctgcaacagcaggccgtgaaggccctccgtgaggaacaggactcgcagaaacacggatttgagacagaaatcagggaatacaaggagcaaatcaaacagcactcccagacgatcgtgagcctcgaggaaagactccaaaaagtgactgagcaccataaaaaaatagaaggagagattgcaaccttgaaggacagtgacccag

SEQ ID NO: 10963 - DNA, 455 bp, Canis familiaris
agctctgacacaggactgtccttgtatctggaatatctcctggtatattataaaaaaattacaagccaaacccaggaacttcagatcaagatccacagctctcaggaaacccagcagtcttttatgcaagagaagttgcaggagcatctggcagagaaggagaagctgaatgaggataggctgcagcaagaggagaagctgaaagccaaaatcaagaagctgatggaagagaaggcggctttggaggaaagcatcactgaagagaaaaacagagcaaaagaagcattagaagaagaacagaagagaatccaagagctggagaatcgcttagcctgccaaaagaaggttttggagaccagcatggcccaggagaaaaggaaggcaaaggaagctttagagacagaaaagagaaaagtgcaagatctggagaaccacttgacccaacagaaggagat

SEQ ID NO: 10964 - DNA, 425 bp, Canis familiaris
atagcacagacatcacaggttcaatggacatcatggatattgcagcgttcacagctgtagagaccccacatgagtacacatgctcagaccctgtacatgcggtagaaagcattgatttctcagatttctccgatgtcactgatgtcaccgacgtcacagatgttccagaaaatgaggtcacagaggccccagatataaatattgtcactgaagttacagaagtcacagacctctgtgatgtcccaaactcagaggtcatagtggtgtttgaaaatgatgatatactgagggccaagcaagaagaaaaggaaaaaatggaaaatattctgaagcctgggtgtctacgagatacaaaaagtaagaatgagttcaaagaatcctcaaaacatgtcaccatctcaaatgtaacactgactttccaaggt

SEQ ID NO: 10965 - DNA, 388 bp, Canis familiaris
aaggctatatcagcgcagtgctccgggaccagcgtattgacgacgtggccatcgtgggccactcggacaatcgctgcgtgtgggcatcacgccctggcggccttctggctgccatatccccgcaggaggtgggtgtgctcacagggcccgaccgccgcactttcctgcaggcaggtctgagcattgcaggccgccgctgctgcgtcctccgtgaccacttgctgtctgagggcgatggcgttctggacgcacgcactaaggggctggatgggcgcgccatctgcgtaggccacaccccgcgcgtgctccttgtgcttatgggccgtcgtggcgcgcacggcggcatcctcaataagacagcgcatgaactgatcaacgggctccgcac

SEQ ID NO: 10966 - DNA, 352 bp, Canis familiaris
tagctgcaattgataatggtctggcatttccctttaagcatcctgatgagtggagaacatatccatttcactgggcttggcttcctcaagcaaaagttcctttttctgaagaaataagaaatttaattctaccatatatttctgacatgaattttgtgcaagatttatgtgaagatcttcatgaactttttaagaccgacagaagatttaacaaagccacttttgaaagtcagatgtctgtgatgagaggtcagatcttaaatcttactcaggcactgaaagacgggaagagtcctgtgcagctggtacaaatgccttgtgtgattgtggagcgcagtcaaggtggaaatca

SEQ ID NO: 10967 - DNA, 543 bp, Canis familiaris
catgcccaccttcttacagatgtgtgagccctactttctctacctggaggcagctgcacggagtgtgccccccatctacggagccctgcaggagctggtccgaaagggggtgtgtaaaaggggagccctgcctcattcccccactctcctgtctactgtcagcatctcctgtttcttctgtgggaggttctccatcagcccttcccatgaagtgtccatcttcagatactgtgccccagccgcctacaccgccagccgcttcccccgatacctctataagaagatgcgatggaacctggaaaccaccccagagcccagtggcagggggcaagattcccatgtggattactacttcctgtgctatcgagatacatgggaagacacaggcaagagcccggccaattcgtgcccccagatccagaagctgtggtccattggccgctgggtgccgctgggacctgcggaggatgacctttattcatggattttgtgcccgcagccgccgggagactaccagcagctgctgaccatcggcttcgagga

SEQ ID NO: 10968 - DNA, 354 bp, Canis familiaris
gaggccacttccgaatccggcaaaacctcccggagcatgcccagggctggctggggagcaaatggctctggctgtttttcgttgttgtgctgtacgtgatactgaagtttcgaggagatagtgagaagagtaaggagcagaatccttccggccttcgaggctgtccatttcgctctccactaaagaaaaatcaaaatgcttcccccaacaaagactatgcattcaataccctaacccaactggagatggaccttgtgaaattcgtgtccaaggtgcggaacctgaaagtcgccatggcaactggcagtaacctcaagcttcagcacttggaggtacctccagagccacacaata

SEQ ID NO: 10969 - DNA, 362 bp, Canis familiaris
accctcttcctacagactgggatgtgctgtgatgcagcgattatcaccaattccccaccatggttgttagcttcttaccctgaaggcaacttgctccagttgacccaggaagaaattcaaatcttgctggcgagagaggggagagagaagttgtttcttcaaggaatcacccttgcagggaccaaatgcttattgattcgggacaacctttacactgagggcaacaataccatggacctccgcaccaaaggccagagtcggggcagccaggcagttactgtagttcagattgaatctgtataccttgtggtgatgggacaaaaaggaacagaaggaggtcctctcaaccttaaggcttttga

SEQ ID NO: 10970 - DNA, 87 bp, Canis familiaris
gaagactctgaatgaatgcacttatgtgtcagagtaggagagacaaaattgagtgttgacaaaccgtatgcaaaccaataaaattat

SEQ ID NO: 10971 - DNA, 153 bp, Canis familiaris
aggtttcaacaaggcctacatcctgttgggacagttccttctgatgcacaagaatgaagccgaatttcagaagtggctcatttgttgttgtggtgccaccgagagtgaggcccaggagagttctcactgtctgaaggagtggtgctcctgctt

SEQ ID NO: 10972 - DNA, 466 bp, Canis familiaris
gatggctctttcctggtacgagatagctctgatcctcgttacatcctgagcctcagtttccggtcacagggtatcacccaccacacgagaatggagcactacagaggaactttcagcctgtggtgtcatcccaagtttgaggaccgctgtcaatcagtggtggagttcattaagagagccatcatgcattccaagaatgggaagtttctctatttcttgagatccagggttccaggactaccaccaactccagtccagctgctctatccagtgtctagattcagcaatgtcaaatccctccagcacctttgcagattccgaatccgacagctcgtccggatagatcacatcccggatctcccactgcctaaacctctgatctcttatatccgaaagttctactactatgatcctcaggaagaggtatacctgtctctaaaggaagcgcagctcatttccaaacaga

SEQ ID NO: 10973 - DNA, 98 bp, Canis familiaris
agaagaaagtgaaaccacccaggattttgatcaccaaagacgggaaagctttgaatgtaaatgaccccaaacttgacttctccttgaaagatgatgaa

SEQ ID NO: 10974 - DNA, 445 bp, Canis familiaris
atcctggaccttgctgtctataggtatatggacacctctttgatcaatgttgatgtgcagccaacttacgtgcgagtcacggtcaaaggaaagccattccagcttgtccttcctgcagaagtcaaacctgacagcagctctgctaagcgatctcagacaacagggcatttggtgatctgcatgcccaaggtagatggaataatcacaggttggcgaccaacctcaaagtctgggaagagtaccgtggacagccgcagagagcccacaaaccaaagaagcaagcaaattgagaaactagaagtagatcctagcaagcgttccatccctgatgtggctaacatagttcaagagaaaaaacacaggctccaaagagttcgagctgaacccaaaattataccaagtgaggaaaatcctgactttgaagataaccctgaagtgcctccat

SEQ ID NO: 10975 - DNA, 591 bp, Canis familiaris
  misc_feature (145)..(145): n is a, c, g, or t
  misc_feature (190)..(190): n is a, c, g, or t
  misc_feature (337)..(337): n is a, c, g, or t
  misc_feature (357)..(357): n is a, c, g, or t
  misc_feature (378)..(378): n is a, c, g, or t
tgctgcaccagcatgctatgaaaaactgaacgtattaggtgatcgatttgggaactgtggggtgagggtggtacgaggaggaggaaaacctgttagatgtgaagaagatgatgttctttgtggaatgctgcactgtcgtgatgtncaagaaattcctggtggaggtgaccatgttacatttcgtcacatngtagtaacaggtattaatcaagaaaaatgctttggatacgatgcacaccatgggacagagatcccagaaatggggctagttgtggatggggcaacatgtggcccaggaaaatactgcttgaatcagaattgtactttttatcaaganttgggttttgactgtgatgncagtacatgcaatttcagagnagtgtgtaacagcaagaaacactgtcactgtatgagaggttggaaacccccaacatgtgaagagaaaggagcaggtggtagtatagatagtggccctccacctgacagagaatatggttttcgaaccagaataatttttagtatacaccaaacattacttctactgattattcgtttaagtctttttctgatttcaggcatcactggtgcctc

SEQ ID NO: 10976 - DNA, 578 bp, Canis familiaris
gctatcaagaaatcaactccctgggaaaccgtttcggccactgtggtataagtggcacgacatacctaaaatgtaatatctccgatatcttttgtggaagagttcagtgtgacaatgtgacaaatattccccatctgagagatcattctactctgcagcaaactcacatcaatggtgtcacctgctggagtattgattatcacttgggaatggacacacctgatgttggtgaagtaaaagatggcaccatgtgtggtacaggaaagatctgcatacgcaagaaatgtgtcagtttgtctctcttgtcacaagtctgcctggctgagacctgcaacatgaggggcatctgcaataataaacatcactgccactgtggctatgggtggtccccaccctattgcctacacagaggttatggaggtagtgttgagagtggcccagcatctgccaaaaaaggttttttgctactagttgtgagtcttattttatctgttttgcttttattgtcaactgctgtatttatataccatagaaaaactttcggtctcaaggagactaaggctcagtcttcaggttag

SEQ ID NO: 10977 - DNA, 186 bp, Canis familiaris
gtgattttgtttacactcctggctggctcaccaccattctggcaccgacgtcagatcctgatgttacgcatgatcatggagggccagtaccagtttagttcacctgagtgggatgaccgttccaacactgtaaaggacctgatctcaaagctgctacaggtggatcctgaggagcgcctgacagct

SEQ ID NO: 10978 - DNA, 154 bp, Canis familiaris
  misc_feature (70)..(70): n is a, c, g, or t
  misc_feature (96)..(96): n is a, c, g, or t
  misc_feature (105)..(106): n is a, c, g, or t
  misc_feature (113)..(113): n is a, c, g, or t
  misc_feature (119)..(119): n is a, c, g, or t
catacggtatggttttaatactatccttgtgatcctgatttggcgcatttttattgcaagatcgcaaatngcaagaaacatctggtactttgtggntagtctgtnntacaagnttctgncatactttcgagcatccagcactatgagatactga

SEQ ID NO: 10979 - DNA, 386 bp, Canis familiaris
  misc_feature (167)..(167): n is a, c, g, or t
  misc_feature (210)..(210): n is a, c, g, or t
  misc_feature (214)..(214): n is a, c, g, or t
  misc_feature (228)..(228): n is a, c, g, or t
  misc_feature (236)..(236): n is a, c, g, or t
  misc_feature (330)..(330): n is a, c, g, or t
  misc_feature (351)..(351): n is a, c, g, or t
ggacttcgtcacacctgcatgagatcacaagcaggcaccagcgcacaggaaataccaagtgcctattatgtgccaggcctccgtgcgggcggcgaaatacatgggtgaccaagatgtggcctgtgaattcactgagcttacagtctcgtggagaccgcacagcgaangaggcagccctggtacagtgggatgcggcgctacgaggagtcnttcngggtgcaatagggncacagaangacctagaacctcaccaagttccgggatgaagtggaaacattccctgagtgaagtgaacctgaactgaaacccaagaggagtagggagcacctngaggggctcagtcggttaatncgtctgcccttcagctcaggtcatgttcccagacc

SEQ ID NO: 10980 - DNA, 442 bp, Canis familiaris
  misc_feature (252)..(252): n is a, c, g, or t
  misc_feature (349)..(349): n is a, c, g, or t
tgggcagaagcctttgtgggtatcagaagttcacatatcaaatacatctgcccacatgcaccagttatgcctataacattgaatatgaacatggctatgccttcttggtttgatatttttgggctttcaccagattcacaggaggatgaacctggaattaaacaggcagcagaaaatgtaaaagctttgatagagcaagaggtgaagaatggcatcccttctaacagaattgttttgggaggattttctcanggaggagctttatctttatacactgctcttaccacacagcagaaactggctggtgtcactgcactaagttgctggcttccactacggacttcatttncacagggtcctatcagtggtgttaacagagatatttctattcttcagtgccatggagattgcgattttttagttcccctaacatttgcttctc

SEQ ID NO: 10981 - DNA, 512 bp, Canis familiaris
  misc_feature (211)..(211): n is a, c, g, or t
agaattccatccagtctcattcagacaataagtgctccggaacaacccagaaaacaccgaagaagatggtggccattgactgtgaaatggtgggcacgggacccaaggggcatgtcagttccctggctcgatgtagcattgtcaactaccatggagatgtgctctatgacgaatacatccttccgccctgccacatcgtggactaccggantaggtggagtggcatccggaagcagcacatggtgaatgctacacccttcaaggttgcacggggccagatcttgaagatactcacagggaagatagtggtgggccatgccatccacaacgacttcaaagcccttcagtacttccaccccaagtccctcacccgtgacacctcccacattccccccctcaaccggaaggctgactgcccagagaatgccactatgtctctgaagagtctcaccaagaagcttctaaaccgggacatccaggttgggaaaagtggacattcctccgtggaagat

SEQ ID NO: 10982 - DNA, 553 bp, Canis familiaris
gacctggcactctacttcaagaagaggacaatgttccagaagatcgtggatgagtctaagaactacgaggacaggaagagctgggtggagtacctgtccctggagacgacgcggaaggagatagtcataggagggcaggagcctctttcctcaatttctgaccaagcgctgaccccccaagatgactgccttttatgcacccacaaggttgctctgttggtggcggctgagttctgggaacaaggggacttggaaagaacagttctggatcagcagcctattccgatgatggaccggaacaaggcagccgagctccccaaactacaggttggcttcatcgacttcgtgtgcacgttcgtgtacaaggagttttcccgtttccacgaagagatcctgcccatgttcgaccgactgcagaacaacaggaaggaatggaaggccttggctgatgagtacgaggccaagctgaaggccctggaggaggagaagcagcaacaagaggacaggacgacagccaagaaagcgggcacagagatttgcaacggtggccccg

SEQ ID NO: 10983 - DNA, 253 bp, Canis familiaris
accagattgcccctgcatactggaggcccaactcccagatcctgagctgtaacaaatgcgctacatcctttaaagataacgacaccaagcatcactgccgggcctgcggggagggcttctgtgacagctgttcatccaagacccggccagtgcccgagcgtggctggggccctgcgcccgtgagggtgtgtgacaactgctatgaagccaggaatgtccagttagacgtgaccgaggcccaggctgatgatga

SEQ ID NO: 10984 - DNA, 191 bp, Canis familiaris
aagcaaggatcgtttctgtggtacctctatctagataagctgtactgcctgctgtctgtgaggaatgtgaaggccttgctggagtattttcaccttctcgatgtgcaccacaacaacaccttgaatgatgtgctgttctatcacttccttcgtcatgtgactagctggaaacggacacagatcatgattgt

SEQ ID NO: 10985 - DNA, 558 bp, Canis familiaris
cctgctctgggctatccattatgaaaagtcaccaggtgtacgactagaagcttgccgtagcatcctagccctcaatcttcaaggggatcgggtcagagacaccttcctagatgtgctgctcctagagaatcacgaggctgttctaaaggaaattgaccaggcaatgaaaatactcaacttagaaaatgaaggaaaccaagaaatgcttcaggagatcaagaacaggattcaaacactaagccaaaaggacttgctgacacagaaaatattcaagatggagagggtcataggaaaagtgaaggaggaagcaaaacgtgtttacttgcaacccaaggaggggcaaaaaccactgaaactctgtactttactacaagaaacttttcaggatgaagtggtgattcctagaaaaccgtctgaaacttgtgacattaaaacagtcataaagcctgtgaggccccacacaccaaatccctggtcacagagtccagtcctcaacctaaacacaagaagcagaagtcaatcgtcatgtgtgaaagatctacgcagtgcccgggagaa

SEQ ID NO: 10986 - DNA, 214 bp, Canis familiaris
gatatcaccaaagattagaagcataatcatctagaagaaatgctggtagtatggctccatgtatgtgttcaaaaatctctccagcagatagtcttgttttaggggctgtccagattatgattggcatatttcatgttttcatgtggtatttcttattgattttgtatatgggacaaattagaggagtctttgggacgtatgaacctataactta

SEQ ID NO: 10987 - DNA, 260 bp, Canis familiaris
aactggaatccctctattttctcagcaggattcaaagaacgtggcaagaggaaaaaaaagaagcataaagaggtacagaagaagtcaaccaaaagaaattgttaaattgactaatcagacacattatgttcatataacaattgaacatgactcgtgtgtgttttggttaatcagagttttgtagataacatttaatactctactaagattatgtttttaacatgtttagcagcattgtggacatttggtcaaaggttatt

SEQ ID NO: 10988 - DNA, 471 bp, Canis familiaris
gccatgagggccttaattcattttcctccctggcatttgatgatagcgggatgggcaactacatatctgttacaacttcaagtaagattgctaatggtagaaatacaaatacacagagcattattgagaatgatcaagaaagagaagttgttgaagatgacggtgagttgaagtccttctttataaatggtgtggcagatgaagagggctttgaagaagaatgcacttggagaagacagtcattcaacaattattcaccaaagtcctatagccccaaacatgcaactcaatatacttttgtggacagtgatgagcaagatattccttgggtcaccagcaactggaatccctctattttctcagcaggattcaaagaacgtggcaagaggaaaaaaaagaagcataaagaggtacagaagaagtcaaccaaaagaaattgttaaattgactaatcagacacattatgttcat

SEQ ID NO: 10989 - DNA, 473 bp, Canis familiaris
  misc_feature (58)..(58): n is a, c, g, or t
  misc_feature (199)..(199): n is a, c, g, or t
  misc_feature (227)..(227): n is a, c, g, or t
  misc_feature (301)..(301): n is a, c, g, or t
gacatgagcctggtctggcgtccgcgggatgctccttgagccccttctccggctgttncctccggggacggttgtggccacaccgacacgtattttccaaataaatcattgttttattcttgcggcggcggggccgaacacgctactttatttttaatttctttcaacaagcctttacccagcactcatccagcggaancgcttggtgaccgtttgcagggagcgtncgctcgtaggaaatctctggactgagcagtcgtggaagccggcgttggccgcgtccctcctcagatgctctgangactgctgcggcttcccgttaaccccggtgtgcacagagccccactccaggaacgtcttgatccagcgatgccaagaactgacgtttcaagctggaagagcctgtattgtcctcataatagtatagaagaattcaagttaggagagagaggcagcagcgaatgaagactata

SEQ ID NO: 10990 - DNA, 335 bp, Canis familiaris
  misc_feature (233)..(233): n is a, c, g, or t
gttcgtcagtttatgatcttcacacaatctagtgaaaaaacagcagtaagttgtctgtctcaaaatgactggaagttagatgttgcaacagacaattttttccaaaatcctgaactttatatacgagagagtgtaaaaggatcgttggacaggaagaagttagaacaactatacaatagatacaaagatcctcaagatgaaaataaaattggaatagatggtatacagcagtnttgtgatgacctggcactcgatccagccagcattagtgtgttgatcattgcgtggaagttcagagcagcaacacagtgcgagttctccaagcaggagttcat

SEQ ID NO: 10991 - DNA, 444 bp, Canis familiaris
  misc_feature (300)..(300): n is a, c, g, or t
gcttcagaagaaacacctccagcaggagaaggagtgcctcatgtccaagctggtagaggctgaaatggatggagctgctgctgccaagcaagtcatggctttgaaggatactatcgggaagctgaagacggagaaacaaatgacctgcacggacatcaacaccttgacgaggcagaaggaacttctcctgcagaagctgagcacatttgaagagaccaaccgcaccctccgagacctgctgcgggaacagcactgcaaagaggattccgaaaggctgatggagcaacaaggagctctacntaaaacggctggcggaggcggactcagagaaagcgcgcctgctgttactactgcaagacaaggacaaggaggtagaagagctactccaggaaatacaatgtgagaaggctcaagcgaagacagcatccgagctttctaaatcca

SEQ ID NO: 10992 - DNA, 398 bp, Canis familiaris
  misc_feature (27)..(27): n is a, c, g, or t
  misc_feature (35)..(35): n is a, c, g, or t
  misc_feature (158)..(158): n is a, c, g, or t
  misc_feature (280)..(280): n is a, c, g, or t
  misc_feature (294)..(294): n is a, c, g, or t
  misc_feature (297)..(297): n is a, c, g, or t
  misc_feature (313)..(313): n is a, c, g, or t
  misc_feature (322)..(322): n is a, c, g, or t
  misc_feature (346)..(346): n is a, c, g, or t
accatactggagtgactccaacatganggaccccnagagctaccatctggttatctgccagtttttccagctgccttctacccaacccagcaccccctcccccttcccagaattcatgacatcagaacaccggctttccccttttccttgagactcangagggccgaagcaacagccttttgctttttctctctcccctaccaaggggtgaaggaagggatccatcctattgttcagaggcaccagctccctcccctaaatcaggctgagaaggaaccanccagctcttacctnctnctggttgttttctttnccaccccantttattttttgtctcccccccctncccacaaccccagcccctacctctgaagccattttatgaactgtcatgtgcc

SEQ ID NO: 10993 - DNA, 549 bp, Canis familiaris
  misc_feature (235)..(235): n is a, c, g, or t
  misc_feature (455)..(455): n is a, c, g, or t
caagtgacaaaaccatcggcggtggggatgactcgttcaacacgttcttcagcgagactggggctggcaagcatgtgcccagagcagtgtttgtggacctggaacccaccgtggtcgatgaagtgcgcacggggacctacaggcagctcttccacccagagcagctgatcaccgggaaggaggatgcagccaataattacgccagaggccattacaccatcggcaaggagatcgncgacctggtcctggaccggatccggaaactggcggatctgtgcacagggctgcagggcttcctcatcttccacagtttcgggggcggcaccggctctgggtttgcatctctgctcatggagcggctgtcggtggactacggcaagaagtccaagctggaatttgccatctacccggctccccaggtgtccacggccgtggtggagccctacaactccatnctgaccacccacaccaccctggagcattccgactgtgccttcatggtggacaacgaggccatctacgacatatgtcggcgcaacctggatatcg

SEQ ID NO: 10994 - DNA, 243 bp, Canis familiaris
  misc_feature (92)..(106): n is a, c, g, or t
aaatctcttcaagcccaggaggactcccgccacagaagcacagagcataaaagtgtggagctgcggggtgcagagcctcgagcctcagagcnnnnnnnnnnnnnnnagaggaagttggaccagcgaagcatcgacaagaggaacccagaccagcggaccgaagtgatttttgattatgagaaacagctccgaaccctgaaggatgagatagctgttctgtctgctgaaaaatctgtgcttcaa

SEQ ID NO: 10995 - DNA, 588 bp, Canis familiaris
gttgtgttttgtgactgttaccttcaacatatactgtaatgtacaaatttttctcttacttggagacctgttaaaaaatactgaaaaatattcagacttctattttcttgcatattggcacacttattacaacaatgtaattgctatcaccatcttttttgcatggataaagaacatgttcttggcaattattaatgatacctattctgaagtgaaagctgattactcaataggcagacgaccagattttgaacttggtaaaatgattaaaaagagttacaacaatgctcttgaaaagctcagattaaagaaacctgaacaggatgaagacataagtatgaaaggagatttggctgagcaagccagaagagaaggctttgatgaaaatgagatccaaagtgcagagcagatgaaaaagtggaaagacaggcttgagaaaaagtactattccacagaaattcaagatgactaccagcctgtcactcaacaagaatttcgagaactctttttatatgccgtggagctggagaaggaattacactatgtcagtttaaaactaaaccgagtgatgcgaaagctttcagctct

SEQ ID NO: 10996 - DNA, 275 bp, Canis familiaris
ggtcactgcagagataaccttgccaccccctgcacctgagacacaagtctgcaggccagctgaggggagagatgcagaaagacactttggtaccacccccatctgcacctgtgatctcaaacactgtgcagggtgcgagccggcaggccagcgtatccccagcaagagcgagaatgggcactgcaccagcaccaaagcccaccggaagcccagcatatccaaggtgatcctgggggtcatggaggacaaggggatgcacaatcctgtgactctag

SEQ ID NO: 10997 - DNA, 413 bp, Canis familiaris
  misc_feature (28)..(28): n is a, c, g, or t
  misc_feature (52)..(52): n is a, c, g, or t
  misc_feature (69)..(69): n is a, c, g, or t
  misc_feature (123)..(123): n is a, c, g, or t
  misc_feature (254)..(254): n is a, c, g, or t
  misc_feature (287)..(287): n is a, c, g, or t
  misc_feature (331)..(331): n is a, c, g, or t
agaattgctcaagcagccatccttgggncaagcatcccaagaacaggtgccnaaggaacaagaatcccntggaacagccatccttgggacaagaagagatgacccagggagaaaaaaactaancaacaaaaaccatgaaaacaaaatatcagccacgttgtaaagaacaacagtcagaagctagaaaggaccagaaggcaaatgaaaataaaattagacattttttttcacattatactgaagagatggcctgngagtggataccaataaactaaaaaaaatcaccntttatatctacttgacatcagtttttcttcaatcatcgtgcttncatctcacatatggacattttaacagcgagaaaatcacatctggattgaaataagcccatacactctgtcttctcaaaagct

SEQ ID NO: 10998 - DNA, 311 bp, Canis familiaris
gtccccgccagtcggatatttcattcgatttccaagaggttttcgcttgacccaagaaacggtgaaaattgtgggatcatccagttttccagtgaaagtatatgttatgctccatcaaaagagtccacacgtgttatgtgtaaccccacggctgcgaaattcggaaatgatagatccatcattccaatggcatgggccaaaaggaagaattatttcagagaacagcactgcacaagttacatccacaggaagccttgtattccagaactttgaggagggcatgagtggcgtatacacgtgtttcctggaat

SEQ ID NO: 10999 - DNA, 374 bp, Canis familiaris
ggaaataaccacttctcagcaacaatccagaattcaggaacaggaggcccaacttaaacaactagaagatgaaaaaagaaaatcagacgagcatcttaagagcaaccaagaattgtcagaaaagctttctgggttgcagcaagagaaggaagtgctacgtgaaaaatatgggcaacttttgaagcagtttgatgtccatgtgaggaactataatgagaaacatcagcaccacaaagccaaacttcgcagagttaaggaccgtttagttcacgaagtagaactacgagataagaaaattgaaaaactagaacatgaaatcagaattctgcatcaagaaaaggaaaaggataaggcattccgggaccaggtcattg

SEQ ID NO: 11000 - DNA, 179 bp, Canis familiaris
atgaggcgtgcagtcaatccgaatcacttgctgagatgttgccccatgcgaggtcactcgtcgtgtagacgctgcctttgtgcagctgagggaacagtacctcttggcccttgccgcacaatacgtatttatattcacatgtgcctgttgtgggagcagggccggcagatcaccatgat

SEQ ID NO: 11001 - DNA, 456 bp, Canis familiaris
  misc_feature (173)..(173): n is a, c, g, or t
aggatctccgtgctgcccatgtggtggaggatcacgcacagctcccgctggatagcgcaggtgggcgcctcggagctcagcctcctggccttcgccctgctgctggtcatggtcttctccaagaggtggctgcacccctcccggagccgcttctaccagcgctggccgcgcantgtcagcaccggcatctacacgtcggcccacgtcatgtccatggggctcctgcagatctgcaggctgaagagctgtttcccctcggagaacgggaaagatagttttaagctgtggacgaatcacccagtctttggcgtggccattataaccttctgcctggcgctggggctgggctttgtcttcaccatctggctgcacctgccgtacctacctggtcttcagagactgcctttctttagctggattgggacaatcatgagcttctttgaaggtatcccctgg

SEQ ID NO: 11002 - DNA, 273 bp, Canis familiaris
gggctgcggccaaagagttttaccagaagtacgaccctaaggacgtcattggcagaggagtgagctccgtggtgcgccgttgcgttcatcgagctactggccatgagtttgcggtgaagatcatggaggtgacagctgagcgactaagtcctgaacagctagaggaggtgcgagaagccacgcggcgagagacgcacatccttcgccaggtcgccggccacccccacatcatcactctcatcgattcctacgagtcttctagcttcatgttcc

SEQ ID NO: 11003 - DNA, 231 bp, Canis familiaris
ttcatgtatttccttcgaggcagcctaccctggcaaggactcaaggctgatacattaaaagagagatatcaaaaaattggtgacaccaaaaggaacactcccattgaagctctctgtgaaaactttccagaagaaatggcaacctacctgcgatatgtcaggcgattagacttctttgaaaagcctgactatgagtatttacggaccctcttcacagacctctttgaaagg

SEQ ID NO: 11004 - DNA, 240 bp, Canis familiaris
gaaaatgccaatgtcttggcccgaggagcagagtctctactcttcatagagagacctgacttctttgattacccagactcagaccaagccaggatcctggccgtggcccagtttattggggagaaacctgtcatctttgttaactcaggatccaactctgagttcttccatcacatcctggtgggcgctctggtggtggccttcctcttcctcctgtaccagttcttcatacacatgtaa

SEQ ID NO: 11005 - DNA, 134 bp, Canis familiaris
ccagttccacaggatctttggaagctccccaagttattttcgccagatccaaactcttgcccacacaatctggagcccttgctacagtaataggacagagaaaatcaaagtcggtgaagtcagggccaatttaa

SEQ ID NO: 11006 - DNA, 407 bp, Canis familiaris
aaacagaagcagtgcttcaacccctcccacccttcggcctgtcatcagtcctagtggcccaacatggtcagtacagtcagacccccaagctcctgagagccacttcacccctcctggaagcaggagccttcaaacaggtggctttgcgtgggagggagaggtagagaacaacacgtataacaaggctacaggggtggtccctcagcacaagtatcaccccactgcaggcagttaccaactccattttgctctgcagcagcttgaacaacagaaacttcagtcccggcagcttctggaccagagtcgagcccggcaccaggccatctttggcagccagacactatctaactccaatttatggacaataaataatggtgcaggcggtagaatttcaagtgccacggcta

SEQ ID NO: 11007 - DNA, 512 bp, Canis familiaris
gaatcctgtgaacaagcttctgaagccagtgaagcacaaactacagatagtgatgacatagtgacaccagtatctctgaaatgtcctaaggcagactcggagaagatgtgcattgaagtgatctcgctggccttcaacccagaggctgaagtgatgggtgatgagactgtgaggcaggtgtacgtagagtacaagttctgcgatgtgcccttgtcagagacagagactccggtgtccctgaggaaaccgagggcaggagaagagatccacttccacttcagcaaagtgatccacctggacccgctgacgcacgcggcccgaaggcagttcctgcgcgacgcgctgagcggacggggccgcgagcaaggacgtttaaagttcacggtggtaagtgatcctctggacgacgaaaaggaatgtcaagaggtgggatacgcgtttctggagctgcgccaggtcatggaatcaggagacctcgtggaacaagagctagagatcttgagccccgcgga

SEQ ID NO: 11008 - DNA, 518 bp, Canis familiaris
tgtggaagtcgactgcgctctcctttcagttttgcgtatgtaccgagatgtttttcatccaccgcgaattattacccaaagaagcctctgacttcatacgttcgattttctaaagaacagctacccatatttaaagctcagaacccagatgcaaaaaattcagaactaattagaaaaatcgcccaactttggagggaacttcctgaatcagagaaaaaaatctatgaagatgcttatagggcagactggcaggcatacaaagaagagataaacagaattcaagaacagttaactccaagtcagatcatgtctttggaaaaagaaatcctgcaaaaacgtctaaaaaagaaagcattaataaaaaaaagagagttaacaatgcttggaaaacctaaaagacctcgctcagcttataacatttttatagctgaaaggttccaggaaactaaggatggtacatcacaggtaaagctgaagactataaatgaaaactggaaaaatctctctagttctcaaaa

SEQ ID NO: 11009 - DNA, 294 bp, Canis familiaris
ttactacaaacttcgtctgtggccgaaagctcattcatgtaaactgctcaaacctccctcagatggggataacagattttgaggacatgaaggtaatttctcggcatacgcgggcactcctgggaattgaagagccattgttcagacgctccatcaccctgccctacagggacaatattggcttatttttagagcaaaaaggtcatactggggtaaaatctgattccttgacgttctctgaatttgtgcaagcagcaggattacaggattatgctccaaaaataactacccctg

SEQ ID NO: 11010 - DNA, 498 bp, Canis familiaris
aagaaaactgcatctcagccctgagcactgtagtaacttttatgtggaacagtatgggaaaatgtttttccccaatttaacagcttacatgagttctggaccacttgttgccatgatattagctagacataaagccatctcttactggaaagaacttttgggaccaactaataccttagtagctaaggagacacacccagacagtctaagggcaatttatggcacagatgacttaaggaatgcacttcacgggagcaatgattttgccgcagcagaaagagaaattcaattcatgtttcctgatgtgattattgagcccattccagttggacaagctgctaaggactatttaaatttatatgtaacaccaactctgcttcaaggactcacaacactttgtaaggagaaaccagcggatccttttatttggctagctgattggctactgaaaaataatcccaacaaaccaaagctttgtcacaatccagctgcagaaga

SEQ ID NO: 11011 - DNA, 361 bp, Canis familiaris
gggttcagcattcaggagactcctctggtggatatccttttcagccgtgctacctcttcaacattgtctgatctaggccagaatgaccctgttcaggatcacttgctatttaagaagactctcctgccagtctggaagatgattgccagtcacaggttcagcagtccttttctgaagcctgtgtcagaaaggcaggccccaggatacaaggatgtggtgaaaagacctatggacttaactagcctgaaaaggaatctgtctaagggacggattcgtaccatggctcagttccagcgagacctgatgctgatgttccaaaatgctgtgatgtacaatgactctgatcaccatgtgtaccata

SEQ ID NO: 11012 - DNA, 345 bp, Canis familiaris
aacaaaattgaatgctctaagctggaacataggatctatatagccttgtctgtggcccaacaccctggccttgtgtacaaaaatgaagaaatattgcaatagcaaaggtgaacatctaacactagctgtctcctgctagatctcctcgctcagcatttaactataaatacatgtaaaaattacatgtatatggctatattaaaatttgctaaatcctagaagagaaaaaaaatcaactttgaatcacaactaggaattgatgctttaattaatgggaactttttcagaatttttaatttactatggtccagcctaagatcctcatttgtatcaggttttgtgcac

SEQ ID NO: 11013 - DNA, 570 bp, Canis familiaris
  misc_feature (205)..(205): n is a, c, g, or t
gaatgcatccgagctttgggtcagaacaagtctcacaccccattcagagccagcaaactgacgcaggtgctccgggactcctttataggccagaactcctccacttgtatgattgctaccatctctccaggaatggcctcttgtgaaaacaccctcaacactttaagatatgcaaatagagtgaaagaattagctctggatttancgccccaccatcgttgtgtctatccggttggacctgaggtgccacggatgttggaaaatcacattagaaattcaaaaacatcccttcagagggatggatttattaatatacctaatatacagagtgaaaaggaaaaacaggctaaagacatcgaaacattatccactccgttagtggaggatacagggaggacttcatggaaggaatcaagccaatggccagggaacaacatccaggagacagctggtgagggaaattacgatgctgatttttgcattgcccagttattgtccattttggatcagaaaataggtattctgactgagattcaaaagaaactgaaattattacgagctgacctccaa

SEQ ID NO: 11014 - DNA, 210 bp, Canis familiaris
gagtgaagatagtccaagtcccaagagacagcgcctctctcattcagtctttgattatacatcagcatcaccagctccctcaccaccaatgcgaccatgggagatgacatcaaataggcagcccccttcagttcgatcaagccaacatcacttctcaggggaacgatgcaacacacctgcacgcaacagaagaagtcctcctgtcaggcg

SEQ ID NO: 11015 - DNA, 176 bp, Canis familiaris
gagtgaagatagtccaagtcccaagagacagcgcctctctcattcagtctttgattatacatcagcatcaccagctccctcaccaccaatgcgaccatgggagatgacatcaaataggcagcccccttcagttcgatcaagccaacatcacttctcaggggaacgatgcaacacac

SEQ ID NO: 11016 - DNA, 503 bp, Canis familiaris
ggaaaatgcgccacctgctgcatatcctgaaggtggacttgggctgcacatccagagaaaactcagtaaagctggatgatcttgatatgctggatttacatgattttgaacaggctgagaattcaaaagaaaatgaatttagaaataaacacgacaccacaattcaacaggaacgtcaagaataccaaaaagctttggatatgttattgtctataccaaaggatgagaatgagagactctcttcaccaaatgaatttttcttacccgtctataaatcaaagtattcagaaggggtcataattcagcaagtgaatgatgaaacaaatcttggaccttcttcctgggatgaaaaaaatccaagtgtctcagacagcttaacagaccaagagacctctgtgaacgtcattgaaggggacagtgacagtgaaaaggtggagccttcgaatgaattatgttgtcttagcacagaactctccccagctcttcagtttcacagtgttcaa

SEQ ID NO: 11017 - DNA, 191 bp, Canis familiaris
atctattataccagcgtgtcagggtccagggaggtgaagcagagacaggaagaagttaccagaattctagatacttataaaataaagtatgaattaatagatatttccatcagtttgaaggtacttcaagaaatgaggatgaaagtttccactcctaaggctctaccacctcagatattcaatggccaaga

SEQ ID NO: 11018 - DNA, 530 bp, Canis familiaris
gatgccaaatctcagacttgttcaaaaaatagttcaaatatggatttaatactctatttagaggagtctggtgctgaatccatgaaacttgatatgtggttaaagaattactctcagaataattcaaagaagccttcaaagaaggacacaaaaaaggatgcaaaggagtctactgatgcagaatctgtagactcaaaggatgcaaagaaagagccaaagaaagctaaaaaagactcaaagaaaagtgacaagaaaagggatgcaaaaaaagacacagagactactgatgcagaatcagcagactcaaaggattcaaagaaacagtcaaagaaggctaagaaagattcaaagaaaaatgacaagaaaaaggatacaaagaaggatgaaatgtctactgatgctgaatctgagtctgaattggagacaacgaattggaagaaagatgaaaagaaggataagatagattcaaaaaaagatgagaagaaaaaggatgccaagaaggatgaagtgtccactgatgctgattctga

SEQ ID NO: 11019 - DNA, 328 bp, Canis familiaris
gaagcctgagacattcaaaagttcagatgctgaatctgaagagtcactatataaacttgatgccacatctgcagattcaaagaaggaaacactggaactaaagagagaattcaaaatgtcatccaaaaagactacattcaaagaaaagggggaaaaaacaggtacaggtagagtccccccattaagagaaaaaccaccactacctccttgtgagcctttactaccatcacccaagatcaaacgtctctgtcggtgcaagatgcctcctgagcctctaaaaccaagatatgctcctttgcctgaagcaaagtggattcataagcttctt

SEQ ID NO: 11020 - DNA, 72 bp, Canis familiaris
taatctgcacactacatatacttgaacatcagttaaaatggctgcataatgttctactataaggatacatga

SEQ ID NO: 11021 - DNA, 246 bp, Canis familiaris
gaactcagagttcgaggagatccacgaggtgatttcacgctacaagacgctggtaagcatgcaccaggacctcatgcagtcggcgcaggagggccaggagaagatcgagcgggccaaggcgaggctggcgcgctacatggaggagaaagatgacgagatcctgcagcacaacaacgaactggcgcgtctacagatgcgcttcgaccgagcccgcagcgatgtcattatctgggaatctcgctgggc

SEQ ID NO: 11022 - DNA, 506 bp, Canis familiaris
aggaggccaagatcatgcaccgagccatggagcagaagaaggagacgtttcagcgcaggatggaaacgctgaacctgcgctgggaggagctgggcatcaaggaggctcagctgaaggcccacatccagaagtttgagcagttcatccaggagaacgaccagaaacggatccgtgccctgaagaaagccaacaaggagcgggagctgaagaggcagcgggtgcgcgagctggccaaggccaagcaggagatggcggccctgaggctggagcaccagaagctgagcatcaagctgcaggactactccattttcaacaagtacctggagaaggtggtggagaactcagaggaatctcgctgggcacacatccagaacactgcagccaagaagaccctcttgcttggcaccattaagatggccacactgaaccttttccagatcgtgagcaagcagctgaaggagaccaccactgtgtccctggaggacacgcacaaacagctggacatg

SEQ ID NO: 11023 - DNA, 299 bp, Canis familiaris
gacatcccaggagtggtgaaaacatatcgagaggtggtggtcaatgcatcatcaagattaacactcagttttgacctcaagacccacctcaccaatacccccaattcaactgtgttcaagctcttcattaccactggcagaaatggtgctaatcttaaaggatcctgtaccccaagtcaggccttggccattacaacaatacttcttcctgagactcttgtgctatgccatgtgcagttcagtaatactttgctagacatcccagcaagcaaaatcttcaatgtccatgcaggtttcag

SEQ ID NO: 11024 - DNA, 251 bp, Canis familiaris
tgtactactttacatacgacccctggattggcaagttactttacctagaggatttttatgtcatacaagcttaccgaggtctaggtattggagctgaaatgctgaagagattaagtcagatagccatcagaagccagtgtaactgcatgcactttcttgttgtcatttggaaccaagcttctattgactactacactcgtcgaggagctttagacctttcatctgaggagggctggcatctgttcagattt

SEQ ID NO: 11025 - DNA, 240 bp, Canis familiaris
aagagaagcagcagttgcagcgagagctggaagacctcaagtactcaggggaggccacgattgtgagtcagcagaagcggcaagctgagttgcaggagcgcctcaaggccgaagagctgcgccttgctgaggcacaggatcagttggaacggaccaagcgggcgatgcaagtgaccaaggagagccttgaacacctggcgggcaagctgaactgcatcacagtggtggatggccgcttcg

SEQ ID NO: 11026 - DNA, 376 bp, Canis familiaris
caggtcaacgctgggcacttgttcgtgcagcagcacacgcatcctactttccatgcactgcgtagcctggatcagcagatgtacctgtgctactctcagccaggaatccccaccttgcccaccccagtggaaataacggtcatctgcgctgcccccggcgtggacggtgcctggtggcgagcccaagtggtggcctcctatgaggagagcaatgaagtggagatacgctatgtggactacggtggatataagagagtgaaagtggacgtgctccggcagatccgatctgattttgtgactctgccattccagggagcagaggtccttctggacagtgtgatgcccttgtcagatgatgaccacttttcacctgaag

SEQ ID NO: 11027 - DNA, 72 bp, Canis familiaris
gaactcaacagaggcagttattatcccgactgcaaattgacccagtaatggcagaaactctccagatcagtc

SEQ ID NO: 11028 - DNA, 95 bp, Canis familiaris
agttgctcccagaactcgaacttctcaagaagaattgctggcagaaatggtccaagggcaaagcaggacccccagaataagtccccccatgaaag

SEQ ID NO: 11029 - DNA, 546 bp, Canis familiaris
ggcagataggctgccagacccagaagctggaagaggccctgaaagagcacaaatcctccgtgtcttgcattagggtgaagaagaacaatgaggaatgtgtcactgccagcacggatggcacttgcatcatttgggacctggtacgtctccggagaaatcagatgatcctggcaaataccttattccagtgtgtttgttaccacccggaagagttccagatcatcaccagcgggacagacagaaagattgcttactgggaagtatttgatgggtcggtaatcagagagttggaaggctccttgtctgggtcaatcaatggaatggatattaccctggaaggagtgcactttgtcacaggtggaaatgaccatctggtcaaagtttgggattataatgagggtgaagtgactcatgtcggggtgggacacagtggcaacatcacccgcatccggataagtccaggaaatcagtacatcgttagcgtaagtgctgatggagctattttgagatggaagtacccatttacctcatgaggcctcagagatt

SEQ ID NO: 11030 - DNA, 445 bp, Canis familiaris
atccatctgtcacctctttaaataggtacactgacatggataccatcacagaaccagaagacgttcctcagctctcaggtgaatacgaagtggacaagcctgagttacaaacatttgtaagacagccacagcttttgagtaatgatgacattttgaaaaaaatttcagatattaagtcacaggtacaacaggtacctcttgctgaaagcctcaagccagaatacagagaggatattcgagcctctagagagcatctaaaacgaagccttgcgttagcagaagcagcagaacataaactacaaaaaatgtacagatcccagctattaccagtaggacaaagcagtagtggaattgaggacattgaaagttttattaacatgctgtacaattccagatctaaattacctgaatatttagatattagatatgttccaccagagatgag

SEQ ID NO: 11031 - DNA, 36 bp, Canis familiaris
gctgttgcttctactgagcggcattctgtttgcttt

SEQ ID NO: 11032 - DNA, 524 bp, Canis familiaris
cagcccaatgctgaaacccggaagggaaaaaaagaaagaagagaaaagaaggacagaacttccagcaggaaaagttcccatcaccacaggacaggtgaatgtcaccacaggacaggaggaaataagtcgacccggaaatcatcctcccatcggtccttatccggccatgacaaaagagatgacagaaaggagaaggggcagagccatgcaagaagcagaggacacagctctcacaagagtggtacccatggctctgcagcaagggtgtcaaggacagctcacaaattggggaagatcaaatctgcaaatagttcaagtgctataagtaagaaatccagtaaaattggctctttcttcaggaacttgagagccatgcctggttcaaaaacaggggtcccatcacacgatagagaggtagacttcgtggctaagtcattagagaagtgcaacatagagacgaaggtagagaaaaccccagatggcaaagacctggagatctgtagcaccatgacatctgaatcaat

SEQ ID NO: 11033 - DNA, 403 bp, Canis familiaris
ggagctggactgtgccatgttacgccgcctggagaaaaggattctggttgatctcccgagccgggaggccaggcgggccatgatctaccactggctgccccctgtgagcaagagcagagccctagagctgcgcacggagctggagtacggcgtgctgagccagaatgctgcattatgcattgtcttgaaaaaaagatctattagcatttcaagagcactgatcaccataaggtcaattattgtgctgttactgttgtgtttttatccagagagcagcaatttacctggaatccagctggatacagtgaccactgctgacttcttagatgtgctagctcacaccaagccttcagcaaagaatctgactcaaagatactcagcctggcaaagtgagttcgagtct

SEQ ID NO: 11034 - DNA, 108 bp, Canis familiaris
gctattcccctcacagtaattcttcagtccagtgttcagagctgtaaaacatctgaacctaacatttctggcagtgcaggcattactaaaagaaccaccagatctgct

SEQ ID NO: 11035 - DNA, 61 bp, Canis familiaris
gatattaataatgaaccgcagcttggaacatctcctgatactgtgcaacaatgaatacaaa

SEQ ID NO: 11036 - DNA, 555 bp, Canis familiaris
gtctctctaaggagcagaccctacagaggcagaacccagaagctgccaggcctggccaggtgcccatgaggaaaagacagctgcctgcttccttctgggaagagcctcggcccacccacagctaccccctggggctggagggggggctgggccccagggagggacctccctatgagagtaagaaacactgcaaaggcttggagcccttggatcctgagacggccccggtgcccacatccccaagggcaccggctgaaaaggagccactcaagatgtctggggtctccctggtgggccgagtcaatgcctggagctgctgccccttccagtaccatggacagcccgtctacgcaggtcctccaggggccttgcctcagagcccggtccccggcctgggcctgtggaggaaaagccccgcttcccccggggagctggcccacttctgcaagcacgtggatgggccagggcagaaagtgtacagacccgtggttctgaagcccatcccgaccaagcccgctgtgcccccgcccatcttcaatgtcttcggctacctct

SEQ ID NO: 11037 - DNA, 320 bp, Canis familiaris
  misc_feature (259)..(259): n is a, c, g, or t
gcgctaccggcgacaaagacagggacctgcagatgctgttacaggaactctggcggctccaggcaaagcagaggaggctggagagagaggtggagaagcacaagctttttgaagactacctgatgaaggtccttgagaaaatccccaagggtcactacgaaggggaggagccagatgaggcgctggtggggaccatggtggagcattacgagaagctcttcatagtcagccaggacgtccagaagcatctggaggcccnctccgagatgaaacaggtcatctgccagaggctggagtctctagaggagagccacagggct

SEQ ID NO: 11038 - DNA, 454 bp, Canis familiaris
ggccttgggctattcctacctggaatccctgctggggaagagcagggaggtcctcaagcggttggggatggaaccagtgacctcatggatgcctgtggtagagctggtagagaaggatggctcagtgtccagcctgctgaaggtgttcaacgaccagagctcctcggaccaaatcgtgcagtttttgcgcctgctcacctcagccttcatcaagaaccgcgcagacttcttccgacacttcattgatgaggagatggacatcaaagacttctgtactcatgtagtggagcccatggccatggagtgtgaccacatccagatcacagccctgtctcaggcactgaacatcgccctgcaggtggagtatgtggatgagatggacacagcgctgaaccaccacgtgttccccgaggctgccaccccttccgtttacctgctctataaaacatcccac

SEQ ID NO: 11039 - DNA, 463 bp, Canis familiaris
actgggtgcagttcctggtgatcaagaatggccttgagctctacgcaggactctggatcacatgcaaccatgagctgtgctggagccacacacccaagtcaccctattaccttcagttttccagggctttcttcctcatctctgtctttgccacacttgttgcccttgtctggctcatcagttcttgcctgtctagaagaggaagcataaccaccaacttggatctgaaggtatccatactcagcttcatctcagccatctccttgctcctctgcctcgtcctatttctggcacaggtttactggcatgctaaggatgccttggagccagatctcctctggacctatcatattaattggtggagtgacttcttatacatgttttctgggatcatctccttcctcaactatatgactttcagctttctttcccttgatcgaaatgtcagtgcaattcccataga

SEQ ID NO: 11040 - DNA, 319 bp, Canis familiaris
gtgcaggcaacaaatcacaggttttaactggatttcgaaaacccagtgttacagaaaccaatgaagtaggaagaaaaatccagttctgagcagtctttgaatcgacaaatatctactttgcaaggaacttctgattattattctatgagtctcactatttaagaatagaactataaggcttagggtgagtgtggtcaagatgttttgaattcagtaaagaaaacttgccctttgatgtttaaggatgatctaatggatcatataccagctactgagaatgtttttaaaaactaggaagttggccactaattcagtgtat

SEQ ID NO: 11041 - DNA, 115 bp, Canis familiaris
cgaatgttaaccaggtacaatactcagaagctcactgagctgattttacagttttatggcatcagagcagacatgaagagggagtgcaaacatgccaggatgaaggccaataact

SEQ ID NO: 11042 - DNA, 541 bp, Canis familiaris
agccatcaggcccaggaattcggaaactctggaaccttagcaaactctttagaagagaaggtaatgggagaatcaatcagcagtaaaaaaaaggaaaaaaggaagcatgtggaccacgtagaaagttcagtatttatagcacccggcaccgtccgatcctcagatgacctagaagaagacactggtgatcacaaagtactctccaggactagtcacagtgactccagcatttacgttcgacgacatactaacaggtctttggaatcggatcattttagctatgttcaattgaggaacgcagcagatctggatgaccgaagaaaccgaatgttaaccaggtacaatactcagaagctcactgagctgattttacagttttatggcatcagagcagacatgaagagggagtgcaaacatgccaggatgaaggccaataactcgggtgaagccacgttgccggagagccagagcccacagagcgactctctgacgcagtttgtccagcagccggatttgatgtattttattctcttcctctggc

SEQ ID NO: 11043 - DNA, 554 bp, Canis familiaris
gatctttgcagatagtctcattcctaaggatgttctttcttcttccataaggagcatcatgtatggggcaggctttatttgcccacagtgccttgtacttatcagtcagtcctggctgaagaagtttggttactataaaatcatcttaatttccttctacctagaaggaacagcctctattgtcatgttgcttcttggacagcaatactattactttttggccctttatctcactattatcatggtgattgtgcaagcttctttttgcttatttaacctgccactagctgatatggttgatgcagatttactgaaattcaatcggcagtcacctctttcctcaatggtttttggcatcaatgctttgtttacaaaacctgctcagtctttagctcccatgatgatactctctaagctaaaacagtatggatatggaaacccagataaaagtacaattttagatcttcatgatgctatgtttaatttgatttgcctggtccccctgggcattgtactaattcagattttggtttggagcccattctcaatcagga

SEQ ID NO: 11044 - DNA, 557 bp, Canis familiaris
attcctgacagcatactttgcctataaggatggtgatatagattcttctcttgttcagtatgcactacttgcagaaatggggtatgaagtagctcaaagcaattcagcattcattttggaatctaaaaaggctaaaattcttgaaaaggagaagatgtatccaatggcacttctcctatggaatcgagctgccattcaaggcaatgcgtttgctagagtgaaaattggagattaccattactatggctacgggactaagaaagactatcagacagcagccacacattacagcattgcagctgacaagtaccacagcgcacaagccatgttcaatctggcctatatgtatgaacacggtttgggtatcgcaaaggacattcatttggccaggagattatatgatatggctgctcagacaagcccagatgctcacatacctgttttttttgccctcatgaaactggaaactgtgcatttgctccgagatatcctgttttttaattttacaatgagatggaaatggatgaaattggacaacactcttggaccatactggg

SEQ ID NO: 11045 - DNA, 440 bp, Canis familiaris
  misc_feature (322)..(322): n is a, c, g, or t
  misc_feature (391)..(391): n is a, c, g, or t
ctgggccaggacaccttcaaaatttgtaaagaatatctaaggccactgaagaagttcctgcgaaagttgaacctgcccaaggaccttccccagaagaagaagctaaagtacatgaagcagagcctggtggtcctaggggaccacatcaacacctttctgcagcactactgccgaacctgggaaatcaagcactggaggaagatgctctggcgatttgtttctctcttctcagaattggaggcaaaacagcttcgcaggctctacaagtacaccaagagcaaccagacggccaagctcctggtggcggtctgccccttggacnccccggagagctccttgctggcggaccaggaagacaacctgcccaagctctgcagcgcctggggactgnccaataacatcagcggcatgaaggagaggctgtccaagatgcaggctcc

SEQ ID NO: 11046 - DNA, 159 bp, Canis familiaris
  misc_feature (35)..(35): n is a, c, g, or t
  misc_feature (38)..(38): n is a, c, g, or t
  misc_feature (66)..(66): n is a, c, g, or t
  misc_feature (84)..(84): n is a, c, g, or t
cctccaggggtttgtcttaaatatgtcgggggagnccnaatttggacatgtgaacatggtgatggntgagatcgctagagcccnaggagattgcagatgtcagcgtccagatgtgcagccccagcagagcaggaatgtatcagggacagtggcggatgt

SEQ ID NO: 11047 - DNA, 506 bp, Canis familiaris
  misc_feature (325)..(325): n is a, c, g, or t
gaatactgctattgccctaatgggagagtcttcagttgtctttctggatgagccatctactggcttagacccagtagccaggcgcctgctgtggaacaccattacatggatgtgtagaagcaaagctatcatcataacttcccacagcatggaagaatgtgaggccctctgtaccagattggccattatggtaaaggggaagttcaagtgcctgggcagccctcagcacctcaagaacaaatttggtaatgcatacagtctgacagcaaagattaagtttgaaaacaataaaagtaaactagagaagttcaaagaattcatagcnacaactttcccaggttacatcataaaccaggagcaccaagggattatttgctactacattccaaaacaggaaatctgctggggaaaggtgtttaatattttggaggaagctaaagccctattcaatctagaagactactctgtcagccggataacactggagcaaatcttcctgaccattg

SEQ ID NO: 11048 - DNA, 352 bp, Canis familiaris
agactgagtaatgccattgccctaatgggaaagccctcagtcatcttcctagatgagccatcaactggcatggacccagaggcccggcgcctgctctggaacagagtaacaagggcacgtgaaagtgacaaagtcatcatcattacctctcacagtatggaggaatgtgatgctctctgtaccaggctggccatcatggtgaagggaaaaatcatgtgcctgggcagccctcagcacctcaagaacaagtttggcaatgtttacaccctgaaggctaagttcaagatagatacagatgagaaaactttagaggattttaaaaagtatattgcaacagttttcccaggtagtg

SEQ ID NO: 11049 - DNA, 399 bp, Canis familiaris
actggaacctcatgctgacaagcttatcggaacctatagtggaggaaccaaacgcaggctgagcactgctattgctctaatgggaaagtcctcagtcattttgctggatgagccatcagctggcatggaccctgaagcccgacgcctgctctgggatgctgtgacacggacgcgtgaaagtggcaaagccatcattataacttcccacagaatggaggaatgtgatgccttctgtaccaggctggccatcatggtgcagggaaagttcctgtgcctcggcagccctcagcacctcaaaaacaagtttggcaacatttacatcctgaaggtcaaggtcaagaatgatgtacaggataaactggaggatttaaaatatttcatcacactaacattcccagg

SEQ ID NO: 11050 - DNA, 562 bp, Canis familiaris
actaggcaacgtcctgatcgacaagaagcgactggagaaaatcctgctcctgagttacgtctgcaatacccaggcagagtaccagcagggcttccacgagatggtgatgcttttccagctgatggtggaatatgaccacgagaccttctggcttttccagttcttcctgcagaaaatggagcacagctgtgtcatcaacatcggagtaggcaagaacctagacaagctcaacaccctgatcaacttcctggaccccatgtttgctgagcatctacgagggaagggtgcggggactgtgcagtccctcttcccctggttctgtctctgcttccagcacgccttcaagtccttcgacgatgtctggaggctctgggaggttctgctgacagggaagccgtgcaggaacttccaggtgctggtggcctacagcatgctgcagatggtgcgggagcaggtgctgcaggagagcatgaccagcaatgacatcctcctggcctgcaacagcctcatcgaccttgacgctgacgtgctgatctcggctgcctgcttggtttacgctgag

SEQ ID NO: 11051 - DNA, 374 bp, Canis familiaris
  misc_feature (64)..(64): n is a, c, g, or t
  misc_feature (114)..(114): n is a, c, g, or t
gtggtcattgccagggtggttcccaactacaatgattttaaggtcaaccagataaagcaggacncagcttccgtggggctgcccatcacccgcctctccttccctaacccatcngtgatgcgcttcgacgttcctcggggcagccagaacgggtgccctcagctgtccaagcctgggggaccccctgagctgccctcgtggaatcagtccttcctcttccaaggtcgagatggagccaccaacttctcagaagacacagccctggtgctggaatactactcctcgacttccatgaaaggcggtgagccctggaccctcagcaagcccctgggcgtctccgtgttgccactgaagagccgtttgtaccgcaagat

SEQ ID NO: 11052 - DNA, 290 bp, Canis familiaris
aagcagtttgttaatcttccctctctttatttttctaatatatagactttgcttctaatatttagaactagacttcctatttcagttatgtaattgagaagaggggaccttctgactgattctggccagccgtcctctgccgagcgctccagagttttagtttcaatgcaatgagaattctttatagtaaaaaaagatgtttagagtgggaagaagagccttggccttttacattagtagaaagagtatacaccgtttcattaaatgttaaagctagcatcatctattct

SEQ ID NO: 11053 - DNA, 135 bp, Canis familiaris
tgggcctacagctcgtcgcacgatgataacagcacttttgaaggaacatgtccatactgtttccagtttctggttttggataactctagagtgcgcctcaaacctaagtccagactaacacccaaaatacagaaa

SEQ ID NO: 11054 - DNA, 493 bp, Canis familiaris
  misc_feature (41)..(41): n is a, c, g, or t
  misc_feature (59)..(59): n is a, c, g, or t
  misc_feature (69)..(69): n is a, c, g, or t
  misc_feature (95)..(95): n is a, c, g, or t
  misc_feature (150)..(150): n is a, c, g, or t
  misc_feature (175)..(175): n is a, c, g, or t
  misc_feature (217)..(217): n is a, c, g, or t
  misc_feature (315)..(315): n is a, c, g, or t
actactggcatgaaacctgctttgtgtgtgagcattgccgncagccaataggaactaancctttgattncaaaagataatggcaattattgtgtnccatgttttgagaaggagtttgcgcactactgcagcttttgtaagaaggtgatancttcaggtgggataacgtttcatgnccagccatggcataaagagtgttttctgtgcagtggctgtanaaaagagctgtgtgaagaggagtttatgtccagagatgattacccattctgtttggactgctacaaccacctttatgccaaaaagtgtgcagcctgcnacaaacccatcactggtctcagaggtgccaagtttatctgctttcaagaccgccagtggcacagcgaatgctttaactgtgggaagtgctcagtctccttggtgggggaaggcttcctgacccagaacaaggaaatcttctgccgcaagtgtggttctggattggacaccgacatcta

SEQ ID NO: 11055 - DNA, 424 bp, Canis familiaris
  misc_feature (95)..(95): n is a, c, g, or t
gatgaagcactttccacactggattaaccccgaggtgaaaggtcaaaggcataaagaatccattctcctctctaaggatgagacagtgcccaaanccatgacaaaaaaggttgagaagagtccacccctcaccaaacaccctgtgagaggagccaagttggagaataaaacagaggaggagagcatgaccttctttgatgctcctcagtctctagacaatgaactcaagcaacaatcccttcagtccagacattcctggttgctgtgccttcctcataacagctccaagcactgtcctcagctgacttgtgccactcaaccagaaaatccaccccaggtctcagctctcctctcagcagaaggcactggtctacacaaagaaaaaacgcagtgcaggaaaaaggagttcctagtttcctctgca

SEQ ID NO: 11056 - DNA, 242 bp, Canis familiaris
gtgatggtgagatcgctagagccccaggagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccacatcgcaaggtagaaggaaa

SEQ ID NO: 11057 - DNA, 378 bp, Canis familiaris
  misc_feature (253)..(253): n is a, c, g, or t
  misc_feature (285)..(285): n is a, c, g, or t
aagcctagagcccagggtcgaagtcctgatcaatcggattaacgaggttcagcaagcaaaaaagaaagccagtgaggagctgggagaggcccgaactgtttgggaggccctgcagaaggaaatggactcactgagtggagagaaagtacgcctgaaagagatcttgaacaaaaagcaagagaccctaagaatcctcaggctgcactgccaggagaaggagagtgaggcacagaggaagcataccatgctgcangagtgcaaggagcgaatttctgccctgaactnccagattgaggaagagaagaataaacagaggcaactgaggttggattttgaggaacagctagaggatctgatgggccagcacaaggacctctg

SEQ ID NO: 11058 - DNA, 338 bp, Canis familiaris
gagattgacaccctggacagcagcaaggagcacctgctcaaagaagagaagcttgtggaggcaaagctggaagatgtgaagcatcgtctgtgttcccagtttggggctgacggctgctcaaccattgctgaggggctctttctccgcagccaggaggctgcagctgcagtgcatctgtttgaagaggagaacaggaaggcccaggggctcctggatgctgctacacatcaccatgagcagctgcagcagaagtgccaacaattgcagcagaagaggcagaggcttaaagaggagctggaaaagcttgggatgcagatccctgttcaagcccaaagcaa

SEQ ID NO: 11059 - DNA, 119 bp, Canis familiaris
gcccaggagaacctgccaatcctaagctcctaggagtcattcaggagaaagacccagagatgcccaccaaggaaggccctatgccctcttaggcaagaaggactctccctaccctggag

SEQ ID NO: 11060 - DNA, 92 bp, Canis familiaris
cccaattgaacgagacctctacctatccctggaagacttattctttggttgcaccaagaaaattaagatctcccgaagggtgctgaatgagg

SEQ ID NO: 11061 - DNA, 529 bp, Canis familiaris
gagacctgtgacagagctcacccttgactgtaacactcttgtgaacgagctagaacaagattctgaaaaccgaggtactatatacctgtctggagtgagtgaaaccttcaaagaacatctcttacagcagtccaacctcttccttggcctggaagctgtgatcttgcctaaagatcttaaaagcggaaagcaaaaaagatactgtttcctgaaattcaaaaattttggcagtgcccagagggccctcgacattcttaaaggcaaggactggaagctgaaaggccgacatgccctaacccccaggcatctccatgcttggctcaggggcttacctcctgaatcaagaaggcccccggggattcgtgtcatacctcccccctctgagcagcaggccttacaggctctgaaggtggaccacccaaagatagcagcctggcgctggggccggaagataggaaagctctaccacagcctgggcccaggcaccctctgcctcatcctgctgccaggcaccaagagcactcatgga

SEQ ID NO: 11062 - DNA, 248 bp, Canis familiaris
aagaggttcttgagcaggccagagtggaaattcccctgtttcccttcagcattgtccagttctcttttgaacccttttcacccagcctcactgaagagatgaacaagaggatgaggatcaagtggacagagatgtcaactgtttatgctgggccatttagcaaaaattgcaacctcagggctctgaagaggctttttaagagctttggtccaatccggtcaatgactcttgttcttgaaacccatcag

SEQ ID NO: 11063 - DNA, 180 bp, Canis familiaris
aaaagtaagccctaccctgcgcatctaatagctgaattaaggagcacaagtactaactccatacgtgacactgggggctgacccccaagtttctgatgaacgttctgaaccaaactcaccctgtaacagtcagcagtctactattttgaagttaccaccccacttcaaagctttaaatca

SEQ ID NO: 11064 - DNA, 503 bp, Canis familiaris
atttcttcggtttcagctctgcaagctctctcgaagctactttatcctgaagaagaggatgattttgagcctggacagccaaattgttcatctgcttttggagccatggggcctgggaatattggacctccaaacactgaagagctcagagtcatccctcagagcagtgatgaaaatgccgaggagatctggaatccagaagaggttccagagggagcagagcacgatgacatgtgggatgttagagaaatgcctgaatatgaggttatattcaaacagcaggtgggaactgaggatatattcctaggattttcgagaaaggattcttcatccgcatgttgtgaagatctagtggttaaaattaaactgccaaatacgaacccttctgaaattaaaattgatatccaggaattgatcattgacctccgtactcctaataagaagttgttgataactcttcctcaacctgtggaatgcagcagtgccaaagctttctatatcct

SEQ ID NO: 11065 - DNA, 448 bp, Canis familiaris
  misc_feature (270)..(270): n is a, c, g, or t
ggatgggtactcctctactatcaaggacaagattcttaccattgatgtgaaacctggttggaggcagggcacacggatcacctttgagaaggaaggggaccagggccccaatattatcccagccgacatcatcttcatcgtaaaggagaagttacaccctcgctttcgcagggagaacgacaacctcctttttgtgaaccccattcccttgggcaaggctctaacctgctgcaccgtggaagtaaagacactagatgatcgtctgctcancatccccatcaatgacattgtccatcccaagtatttcaagaaggtgccaggtgaggggatgccactacctgaggaccccacgaagaagggggatctcttcattttcttcgacatccagttccctacccgcctcacaccccagaagaagcagatgctgcgccaggcattgctgacataa

SEQ ID NO: 11066 - DNA, 463 bp, Canis familiaris
  misc_feature (403)..(405): n is a, c, g, or t
  misc_feature (417)..(417): n is a, c, g, or t
  misc_feature (419)..(423): n is a, c, g, or t
tcaacgaatcctttcttttagccaaagggaggtttatatctcaggtacaacagacaactcaaaatggctacatgaaatcaagaactgtttggaaagagaaaagaaaaaagagaaaaaggaatttattgtaagaaccctgaactgatgtctgatgattctgggaacagcccttgagatgtcaaagatgataatacagtaacagcatttgggaagtatttctagtcttacacttagccttttggcaggaatttattaagacagaataagcctgtgacttttcaattccgagtacaatttgtttctctaatacatccgcaggagtaatgtgtgatggaatatttccttctgcagcccctccactgtgggtgatgatatgctataataggttctcacaggccatatnnnagtaatataaancnnnnnacatgtacatctgtggcccagtgtcagtgccttaaatgta

SEQ ID NO: 11067 - DNA, 456 bp, Canis familiaris
ggacattcacctgtttgccatttcacacttccatggacgaaaaactcactcacctcccagcatgctttgccactcttttacttacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcagtgttgacagtgactgttcgcttccccagatttccccatcgtgttggcccaaataaaggctttgcgattcagtacttaaagtttgtttaaactgtaacaatacctatgcccatgtgacactttcagacactctgtctaatgtacttttgtttttgtgtttaccaatcttttttagctcactgagagctgtctctctcaatcactcctcaatgttctatctt

SEQ ID NO: 11068 - DNA, 503 bp, Canis familiaris
ctgcggccacgttttctgtagaaaatgtttcctgactgcaatgagagaaagcggaatacattgtcctctctgtcgtggaaatgtgactagaagagagagagcatgtcctgaacgggccttagaccttgaaaatatcatgaggaagttttctggtagctgcagatgctgtgcaaaacagattaaattctatcgcatgagacatcattacaaatcttgtaagaagtatcaagatgaatatggtgtttcctctatcattccaaactttcagatctctcaagattcagtagggaacagtaataggagtgaaacatctacatctgataacacagaaacttatcaagagaatacaagttctgggcatcctacctttaagtgtcccttgtgtcaagaatcaaattttaccagacaacgtttactggatcactgtaacagtaatcacctatttcaaatagttcctgtgaatcttcagctagatgaggaaacccagtatcaaactgctgttg

SEQ ID NO: 11069 - DNA, 538 bp, Canis familiaris
aagcagctcgttgggaagaacttcaacgtggtggtctttgacaaggaaagggatgtatttgtgatgttctatgcaccctggtcagaaaagtgtaaggcgttgttcccagtgttggaggagttgggcagaaagtatcaaaaccactcgacagtcaccattgccaagattgacatcacggcaaatgaaattcagctaatgtacctagaccggtacccctttttcaacctgttccccaccgacactcaacaagctataatgtatacaggagaacataccatgaagggcttttctgacttcctggaaagtcaaatcaagaccaggattgaggatgaggatgagctgttgtctattgaggaaagtgaattgacagaagaggaggcattagctgaagaaaagaagttaccttttatcaaggaagagttaactgaacagaaggtgcttgagctggagaatgtgacaaagctggaagagccagctgggcagaaggaaacagccaaggaggagaaagaaaaggtggctaagccaaagggacctccaa

SEQ ID NO: 11070 - DNA, 430 bp, Canis familiaris
atccgctactgccatggctgtggtgtggcccaccgggacctcaagtgtgagaacgccttgttgcagggcttcaatctgaagctgacagactttggctttgctaaggtgttgcccaagtcacgccgagagctgagccagaccttctgtggcagcacagcctatgccgcccctgaggtgctgcagggtattccccatgatagcaagaagggggacgtctggagcatgggtgtggtcctgtacgtcatgctctgtgccagcctaccttttgacgacacagacattcccaagatgctgtggcagcagcagaagggggtgtccttccctactcatctgggcatctcggccgaatgccaggacctgctcaagcggctcctggaaccagatatgatcctccggccttcaattgaagaagttagttgccatccatggc

SEQ ID NO: 11071 - DNA, 256 bp, Canis familiaris
agaacagatattcactacccactcaccaacttagaccttactccttatatttgtccagtttttcggaaacaccctaaatacaacctctgtgcagtggtgaaccattttggtgatctggatggtggccactacactgctttctgcaagaactcagtgacccaagcctggtatagctttgatgacacacgagtcagtgagattccagatacttcagttcaaactgctacagcctatctcctgttctacagctgccagc

SEQ ID NO: 11072 - DNA, 58 bp, Canis familiaris
gcgtgaagacaagcacattcgccagcgagtcaagattttctgggccaaacaagaacag

SEQ ID NO: 11073 - DNA, 526 bp, Canis familiaris
ggatcatggacatttgcagctcggggccttgctgtttcttggatcccaaaataactcggtttggaatgtccagctgcccgcaagtccccatggaggagcgcatctctaacctgcgcctgagccccaacccagcctcctgccattactacttggagaagatccacccgcctggggaacgcagggctccccagtatgccttcggccaccggtgcccgtacagagtgctggaccccaatccagcccccaaccagtaccagctgcccctcttgttggggcccagcaaccctgtcagccgagctgctccttgctatagtctttcctcggagcacaagagctggttctacaaggagaacgtggcagggggccctgggccagccgcgcactcccggcccgagccctccgtctaccagaaccgcagccccacgtacagcatggccaagcgatttgcctaccccatggaccgcacgcctcggcccggccctggctcccacaacgcccagcaggtgacggtgcacaagccctgcgc

SEQ ID NO: 11074 - DNA, 502 bp, Canis familiaris
  misc_feature (38)..(38): n is a, c, g, or t
  misc_feature (177)..(177): n is a, c, g, or t
  misc_feature (258)..(260): n is a, c, g, or t
gaatgtgccgcggtccaagatctgcgatgactcggacncggagggcagcagcctgggcagcaagactcgccagtggtacagtcggaaggccggccgcgagtcggatggtggttgggaagaatgggaggacggagaggacaaggacggcttcaggcgggagggtctccacgagcactngtctttggagatggagctgcgtcggggcagcatcctgggaagccatctggaggaagacgtcgattccaagaccgagagcgnnntatcttcctcagagtcatcgctcagtatctcgaagcacacaccccatcgagcctactggatagagcagcagaacaggctgccactgcctctgatggaagtcatggagaatgaagctctggaaatcctcaccaaagccctctggagctaccggtcagggattggccgggatcacttcctgaccaagcagctgcagcgatacatcgaggggctcaagaggcgtcggagcaagaggctgcacctc

SEQ ID NO: 11075 - DNA, 51 bp, Canis familiaris
aagaggctgcacctcgtaacgtattgagaacgccgcttccggctcaagtga

SEQ ID NO: 11076 - DNA, 142 bp, Canis familiaris
  misc_feature (38)..(38): n is a, c, g, or t
  misc_feature (61)..(61): n is a, c, g, or t
aagtaccatgagtaagagtaacattaaatcataccctncacttcaacctactaaaagtggnaaagtacgtcatcctgatgagtggggaaagagtatgggttatcgcataccacgaatattcggaactgcaaatcaagaatct

SEQ ID NO: 11077 - DNA, 575 bp, Canis familiaris
aggcaggtccatctgtgactccgagcccccgggacttgcaggagcgggatggcatccgggcggcggccatggcattgttcggggacctggtggccgcgatggcgggcaaggagctaagcagcctgcggcaggtccaccagagcatggtgcccctcttcctgcacctgaaggaccactgtccgggtgtcgtcacgcaggccaagttcaccctgtaccgctgcgcggtgctgctccgctggcggctccggcacacgctcttctgcacgctggcgtgggagaggggcctcagcgcccgccacttcctctggacctgcctgatgacccacagccaggaggagttcggcatccacctggcgcaggccctcagctacctgcacagccgccaccgccacatcaagacctgggcagcgctcttcataggttacaccatctgctaccacccccaggccgtgtcccagatggtgagcagcgtcgacacaaacctgctgttctccacttttgaagatctcaaaaaagacccggagcccagcatccgagtattcgccaccaggcagctctacttcctccagaaggtg

SEQ ID NO: 11078 - DNA, 534 bp, Canis familiaris
aattctaatttcttcttcctgttggtgctgttgatcggactgtgtttggcaataatacctctgacaatcagcatggcacgcatcccttcctcgaaagcctgtgggccattcaccaacttcaacaccacctgggaggtggttcccaagacggtgagcacctttcccagctcactgcagtccctggtctatggcgtcacatcggaagccttcgcagtgcctttcttcatgatcatctgcctcatcatgttttacttcatcgccctggccggagcacacaagcgagtggtggtccagcttcgagagcagctgtccctggaaagtcgtgacaagcgttacctgatccagaaactcacagaagcccagagggatatgaagaaccgactggattatcaatgaggatcccgccacgtgtggctcatgagctgacctagtgacctgccaagactacaggtctgggttcggagcagaagttttaaaatatatttttctggagttgatgttttctgaaggtgactccatatgtgcagctgcggt

SEQ ID NO: 11079 - DNA, 357 bp, Canis familiaris
  misc_feature (33)..(33): n is a, c, g, or t
  misc_feature (37)..(37): n is a, c, g, or t
  misc_feature (39)..(39): n is a, c, g, or t
tgttctttacgttttcagtttcatctctagacnctgnanaaaggacctaagccatgtgtggaccataattgtgaatcttccaaaagactgtctaaggctaaaaatcttatagagagattttttaatcaacaagtagaagttctaggcagacgttcagagccattgcctgaaatatactatattgaaggtactctccaaatggtttggattaatcgctgctttccagggtatggaatgaataccctgaaacatccaagatgtcctgaatgctgtgtgatctgcagccctggatcttataacccccgtgatggaactcactgccttcagtgcaacagcagcctggcgtttggagcaaaa

SEQ ID NO: 11080 - DNA, 478 bp, Canis familiaris
aagtctcgcttaagtgtctcaatccctttgaggatgtccagttacatattcaagaggccagttaccagaatcacatctcatcgtggcaatgaggtcagatgccatcactgggaggaaactctggacaagccccaacaggtgtactggcagaagaggctgcaaggtctccaggcctgcagcagcacaggggagccattaagcactttggatcttgcgaaaatcttacaaaaacttgcacctacatgcacaggtgactatctgccaggtgttcttgcagggggtctgaactctagccccatacccacccctgccgggtcttcagatttggcaaagttgattccaggagctggcctgactatcccacagctcctgtgcaaacaatttctggtgactgaggaagatatcaggaaacaggacaggaaagtgaagacagcaagacaaaggttggccatggcactggctgtagacaggttcgcta

SEQ ID NO: 11081 - DNA, 548 bp, Canis familiaris
tgctagatcaaccaatacccacgggtcagaatgggaccacagaagaagtgacttcagaagaagaggaagatgaggagatggctgaagacatagaagacttggatcactatgagatgaaggaagaagagcctattagtggaaaaaagtcagaggatgaaggaattgaaaaggaaaacttggcaatactagagaaaattaggaagactcaaaggcaagaccatctcaatggtgcagtgtctgggtctgtgcaagcttcagatagacttatgaaagagctcagggacatataccgatcacagagttataaagcagggatttattcagtggaactcataaatgacagtttatatgactggcatgttaaactacagaaggttgatcctgacagtcctttgcacagtgatcttcagatcttaaaagaaaaagaaggcatagaatatattttgcttaatttctcttttaaggataactttccatttgatcctccatttgttcgagtggtgttacctgttctctcaggagggctggtatacccctccaaaggaaga

SEQ ID NO: 11082 - DNA, 47 bp, Canis familiaris
gacctgaagccgctgttcaagaggttcacacagacccgctgggcagc

SEQ ID NO: 11083 - DNA, 583 bp, Canis familiaris
aagagtcacggctttgacaccctgctccagagcctgtttggggacctgaagccgctgttcaagaggttcacacagacccgctgggcagccccggcgcagaccctgggggacatcatctccaccgtgggcgaaaggctgcctgagttctccgagctccacgactgtttccagaaggagctcatggaggtggtgcacctgcacctggtgaaggagtacatcatccgcctcagcaagcggagcctggtcctcaaggtggtggagcagcagcggcagctggccgagcacatcctggccaacgccgaggtcatccagcgcttctgcactcagaacggctcgtcagcgacctggctgcaccacgccctccccacgctcgctgagatcattcgcctgcaagaccccagtgccatcaagattgaggtggccacttacgccacccggtaccccgacttcagcaaaggccacctgagtgccatcttggccatcaagggaaacctgtcgagcaacgaggtcaagagcatccggagcatcctggacgtcagcgaggggatgcagcagtcctccaagcccctattttcacttataa

SEQ ID NO: 11084 - DNA, 567 bp, Canis familiaris
  misc_feature (63)..(63): n is a, c, g, or t
gagccagagcattttgttcttcaccatgaccagactccagcatcgcacatcctggaaggaaantggtgccctggcccgggcagcctcaccacctccatgcactccttccatggccaggtcagcaggaagggggagggagacaccccccaccccccaggcccaggcttaggctcaccaggggctctggcttcgccaagtcctaccccatccctaatctcgcgcgctcccgcccaggggccgtgcctctcctccctcagcccctcagctcgactacccccacccaaatctccagaaacagattttttaaccacgaaccagaagatgctgaagcctcacagaacagctccggcctccgtgactgaggacatgctacagcggtgcaagtatggccacattgagcccccgctgggtggacagcgcttcttctcaacccaatacgaggatgagtttgtctccaagttccagggcccagcagtgttgagattggtcaatcttcaggacagccatgtgcctctgggctcccctcacccctggggctgtggggctgggaacatagaccctcgggcc

SEQ ID NO: 11085 - DNA, 226 bp, Canis familiaris
  misc_feature (52)..(52): n is a, c, g, or t
  misc_feature (159)..(161): n is a, c, g, or t
ctccctctacaataagtctcttgctgaagtagttccagaacttaacctccanatcaacagaattcatcttaacttttataggtttctgcaggttgggtcaactagtgttgctacaatatagatgacatattttttaaaatgtaaatgtagtcaagttcnnntagattttagtagtttgtaatatcatctaacattttttaaagaataaacaacttgccttgtgacc

SEQ ID NO: 11086 - DNA, 252 bp, Canis familiaris
atggtggaggctgagcacctctcagcccgtggctgctggactgtcttcaccaacttcttatgctccagaaaaggaacactcctgtgtgctgagatgatattgtgcctggtgattctaatctggttcagcctctcaacaccagcatactcctctctgtcagtagttgagatgatccttgctgagatcttctttgtcatctacatgtgtgacctagcctccaagatacaatactggtcttggattgatttcttc

SEQ ID NO: 11087 - DNA, 401 bp, Canis familiaris
gaattgcagggtttgattggacagttggatgaggtcagtcttgagaagaacccttgcatccgggaagctcggagaagagcggtgattgaggtacaaacccttataacttacattgacttgaaggaggccctggagaagaggaagtcgtttgctagtgaggagcacccgtcacataaagcagtctggaacatccttggaaacttgtccgagatccagggggaagttctttcatttgatgggaaccgaactgataagaactacatccggctggaagagctgctcaccaagcagctgctggccctggatgccgtggacccgcaaggggaagagaagtgcaaggctgccaggaaacaggcagtgaagctcgcccagaacatcctcagctatctcgacttgaaatc

SEQ ID NO: 11088 - DNA, 135 bp, Canis familiaris
agcttctcctcgattggcaaggatacagaaaagaaggacctggccctctgcccccaacaatccaagtctcaaatggcccctgggggcctgctggaccttgacaaccctgaactggacacagacacctcgtcgaca

SEQ ID NO: 11089 - DNA, 398 bp, Canis familiaris
gccggaggcacccttcatctgtgaacacacagtcagcgattccacggctgtgatttcctggacctatgccctgggcaagcagcaggtcagtttctaccaggtcctgttgcaggaagtggccaagacaaatgataatgagccacccaaggcaaagaatcgcccatggatcttcaacaagatcttgggcaccaccgtcaagctgatggagctgaagcctaacacgagttactgtctcaccgtccgtgcagctaacacagctggggtggggaagtggtgcaagccctacaaatttgcaactgtggccactgacttgaacagcttccctgagaacaaccccatccagattactgtgcagcgcaaggaaccccagaggaaaacggtgtccatcgggctagagg

SEQ ID NO: 11090 - DNA, 514 bp, Canis familiaris
aaagttcacttttatcgaggcctgtgttaaccctcgttctgtcaccttgttggttaaaggaccaaataagcatactctcacacaaatcaaggatgctataagggatggacttcgtgccatcaaaaatgccattgaagatggctgtgtagttccgggagcaggtgcagttgaagtggcaatagcagaagctcttgttacatacaagcacagtataaaaggaagagctcgtcttggagtccaagcttttgctgatgccctcctcattattcctaaggttcttgctcagaattctggttttgacctacaagaaacactagtaaaagttcagactgaacattcagaatcaaagcaacctgttggcatagatttgaatacaggtgagcccatgatagcagcagatgcaggagtttgggataattattgtgtgaaaaaacaacttcttcactcttgcacggtgattgccaccaacattctcctggttgatgaaattatgcgagctggtatgtcttctctt

SEQ ID NO: 11091 - DNA, 336 bp, Canis familiaris
ccatgagagcgctgggcttcgagcccaggaaggaagagatgaagaagatgatctccgaagtagacaaggagggcacggggaaaatcagcttcaatgactttttgggcgtgatgacccagaagatggccgagaaggacaccaaagaagagatcctgaaggctttcaggctctttgatgacgatgaaactggcaagatctctttcaaaaacctaaagcgcgtggccgttgagttaggggaaaatctcactgacgaggagctacaggaaatgatagatgaagccgatcgggatggagatggcgaggtgaacgaggaagagtttcttcggatcatgaaaa

SEQ ID NO: 11092 - DNA, 339 bp, Canis familiaris
  misc_feature (61)..(61): n is a, c, g, or t
  misc_feature (113)..(113): n is a, c, g, or t
  misc_feature (195)..(195): n is a, c, g, or t
accatgtcccagaaattgagtttactgttgcttgtattcggactcatttggggattgatgntactgcactatacttttcaacaaccaagacatcaaagcagtgtcaagttacntgaacaaatactagacttgagcaaaagatatgttaaagctctagcagaggaaaataagaacacagtggatgctgagaatggngcttctatggcaggatatgcggatctaaaaagaacaattgctgtccttttagatgacattttacaacgcttggtaaagctggagaacaaagtcgactatattgttgtgaacggctcggcaaccaacactaccaatggcaccagt

SEQ ID NO: 11093 - DNA, 532 bp, Canis familiaris
  misc_feature (153)..(153): n is a, c, g, or t
  misc_feature (205)..(205): n is a, c, g, or t
  misc_feature (287)..(287): n is a, c, g, or t
  misc_feature (437)..(437): n is a, c, g, or t
caaaagtcttgattgacggcatacatctagtcatcgttcttcagttgagtgtgtttgcttcatcagaaatgatttttacaatctcaagaaaaaccatgtcccagaaattgagtttactgttgcttgtattcggactcatttggggattgatgntactgcactatacttttcaacaaccaagacatcaaagcagtgtcaagttacntgaacaaatactagacttgagcaaaagatatgttaaagctctagcagaggaaaataagaacacagtggatgctgagaatggngcttctatggcaggatatgcggatctaaaaagaacaattgctgtccttttagatgacattttacaacgcttggtaaagctggagaacaaagtcgactatattgttgtgaacggctcggcaaccaacactaccaatggcaccagtggaaanctggtgccagtaaccacaaataaaaggataaatgcatcaggcagcattagatagcagttgaagatcacctgtgctgctacatccaccggggatta

SEQ ID NO: 11094 - DNA, 461 bp, Canis familiaris
  misc_feature (364)..(364): n is a, c, g, or t
aagccagggtctacagtcgctgcgagctggccaaagtgctccaggatttcggcatggagggataccggggatacaccctggctgactgggtctgtcttgcatatttcacaagtggcttcaacacagctgctgtggaccacgaggctgatggaagtactaacaacggcattttccagatcaacagccggaagtggtgcaaaaatctcaacacagaggtccccaatgtgtgccagatgtactgctctgacttgttgaatcctaaccttaaggatactgttatctgtgccatgaagatcactcaacagccccaaggtctggccagctgggaggcctggaggcgtcactgccagggcaaggacctcanagactgggtggatggctgtgacttgtaggatcctctgtggatggaccaggccacgcacagcaggctgggagatgtggtttggtttctgatccaggct

SEQ ID NO: 11095 - DNA, 359 bp, Canis familiaris
  misc_feature (278)..(278): n is a, c, g, or t
gaggagaaacacttgctgagtctaaatgccattcgagatgagtctgaactgaccaacttcgagatgaagatagtggaatatggcaaggacatcacggagctgttcaacgtgctcatgacactggagatgcaattggtagagcagctggaggagactataaacatgtttgaaaggaacatcattgacttggggcacctactccacccctggcctttgcttaacttggccacaatggctcagtgccgggacctggagaaccaccaccacgagaagctccnagagatctccatcaatactctcgagaagatactgaagggtgatgtcgatgaggacctgcctgatgacttgcgcccgctttt

SEQ ID NO: 11096 - DNA, 478 bp, Canis familiaris
tggagtctcagttgcaccagttgaccatcctggcctcagttctgctagtggccagtagtttctcaggcagtgttttgtttggctcacctcagtttgtggataagctgaaacatataaccaaagacctgatggaggagtttaagtccaggcctgaggaggctctgcagactgtgagtgaacaggtgtctcaggaaatccatcaaagcctcaagaacatgggccttgctgctctgagcagtgacaacacagcatctctgataggacagctccagaacattgccaagaaggaaaattgtgtccgcagtgtcattgatcagcggatccacctgtttctcaaatgctgtttggtcctcggtgtgcagagatctctcttagacctccctggaggcctcactgtcatcgaagcagaactggcggaactaggccaaaagtttgtcagcctaacgcatcacaatcagaaagtgtttggcccctacta

SEQ ID NO: 11097 - DNA, 385 bp, Canis familiaris
  misc_feature (55)..(55): n is a, c, g, or t
  misc_feature (64)..(64): n is a, c, g, or t
gaagatactctcacagctgttacagaggaagctgagagcactttttaaaaacctnagaaatgtnagatttttcctggtgctcatacctgatgtgggccctaatgatatctctgtataacaaagctgctacaaagcccacagattttgtgcaaaagaaaatacaaaacaagttggatttttcttcttagtattgaagaaatttctctgcacatatttttgtaggctccaagtggaaagcttttccctatttaaatatattattacaaggaaaaatttattttctaagtactctgaacttgtcaactctaactctgaagctgtcaactctccctattgaacttttataagagaccataaaaaaaatttgtgattgtctctagagtgc

SEQ ID NO: 11098 - DNA, 504 bp, Canis familiaris
atgcagccagacgttttattccttgtcaggaccaagatgtcaagtgtggaagactgcagtgtagtaatatcactcatctccctcagttgcaagaacatgtgggattccatcagtctaagatatcaggggtctggtgttttggagtggattcccatcgtggcacaggaacaaatgatgttggtcatgtgagacctggtaccccctgtgctcctgaaaaatactgtgcaaattctgtctgcaatggtactataagtgacatgaattatgactgtatccctgagaaatgcaatcgcaggggcatttgcaacaacaacaggaactgtcattgccacataggctgggatcccccattctgcaaattgcgaggtaaaggagggagtatagacagtggaccccctccaagaagaaggcgggcagtcaggcaaagtcgtgaggcagtggtatatctgagagtcatctttgctcgaatctatgccttcattgctgcactcctctttggtgttg

SEQ ID NO: 11099 - DNA, 198 bp, Canis familiaris
ctgggccttagcagcatgtgcctgtgctgcacagaagatgatgccatccaagtgaaccccgaagggccaagatggcagcatccttcggaagtcactgcaaggcagtccagagataaacgcattgagaatatgaaaaacataaggaaagagaagaggaaatttaataaacggtttgcaagacctgctcctcttccagaa

SEQ ID NO: 11100 - DNA, 526 bp, Canis familiaris
  misc_feature (55)..(55): n is a, c, g, or t
  misc_feature (103)..(103): n is a, c, g, or t
tgacccggctcaaggcacagacagagaagctggatgaggagcggcagcgcatgtntgaccggctggaggacacgagcctgcggctcaaggatgagacggatcnatacaagcgcgtgatggacaagctgcggcagaaccgccttgagttccagaaggagcgggaggcgacgcaggagctcatcgaggacctgcggaaggagctggagcacctgcagatgttcaagctggactgcgagcggccgggcaggggtcgcagctcgtcctctggcctgggcgagttcaataccagggcccgcgaggtggagctggagcatgaggtcaagcggctcaagcaggagaatcataagctgcgggatcagaatgatgacttgaatggacagatcttgagcctcagcctctatgaagcaaagaacctctttgccacccagaccaaagcccagtctctggctgcagaaatagacacagcctctcgcgatgagctcatggaagccctaaaggaacaggaggagatcaacttccggctgag

SEQ ID NO: 11101 - DNA, 403 bp, Canis familiaris
  misc_feature (77)..(77): n is a, c, g, or t
  misc_feature (118)..(118): n is a, c, g, or t
  misc_feature (136)..(136): n is a, c, g, or t
  misc_feature (171)..(171): n is a, c, g, or t
  misc_feature (252)..(252): n is a, c, g, or t
  misc_feature (309)..(309): n is a, c, g, or t
actttccaggttcattttcacagaccatataggaaactttaatgaagacacattttgtaaggaagcaagttctagcnctttctcaaataatccttgaaatctttaatccagcatttcngggtgttcccatttaatnaactaaaaatgaacaattctaatttgttgagcaanggtaatttcaaaattgtaatctgagcatgatcatacagtttcctcgcttctgatattttcgatttatgctcattagtgcgnatttttatccttgcattctaactttaaactcaaattaatgctatgattatcttgctngattaataattcttgatttttaggcttatcaatacttaatatgtttaggatctaaagaaaatgacaccaggctattataaatccccgtgaaatc

SEQ ID NO: 11102 - DNA, 562 bp, Canis familiaris
aacagtagtaacagccagtctgagaaagaagatggcactataagcaatagtaatcagaatgggatgtcatctaatggaccaggggaaatgttgaacaaagaagaaatcaaagttgaggggttacatgttaacggaccagcaggtggaaataagagaccacttcatgcagatatggatactaatggttatgaaacagacaaccttaccactgaccaaaaacttggccatatgactgcaagaaatgaaaatgattttgatgagaaaagtgagagacctgccaaaaggcgaagggtaaacagcaatggaaaagaaagtccaggttcttcagaatttttccaagaagcaatgtcacatggaaaatttgaagagcttgaaaacacagatgactaaatcttaaacttattttactttctttggagtaaaatctggtgtgactaaaattttcagggttgatgggttaccttaaaaagttgatttccttgaagcagttggttaaaattttgaaaatttgaattgagtcctaactttagtaaataagatttcataattctgccctttgtag

SEQ ID NO: 11103 - DNA, 355 bp, Canis familiaris
ggccagaacgtatttatcagagtccatatggagttactgctgtggatttctcaattggagcacctaatcttctagccgttggctatcacaatggcacaattgccatttataatgtacagagcaacagtaatgttccagttctggatagtagtgaatcacctcaaaaacatttgggacctgtatggcaattacaatggatagaacaagatcgagggacaacaggtgatgacaaaagagaaatacttgtttctatatcagcagatggaagaatctccaaatgggttatacggaaaggactagacagtcacggatacaaatatctatttggctggcaccgaagaaggccatattcaca

SEQ ID NO: 11104 - DNA, 379 bp, Canis familiaris
tgatgtgttcttaagctgttctgcagattggggtgttattatatggcaacaggagaataccaagccatttttgagcttttatccaactacttatgttgtttatgatgttgcctggtctccaaaatcctcctatatatttgcagctgcaaatgagagcagagtagagatttgggaccttcacaccagcactttggatcctctcattgtgaatgttgctaaccctggaatcaagttcacaactgttctctttgccaaacaaacagattgccttctagtgggtgacagtgatggacaggttgctgtgtatgaactaagaaatatgcccactgcgttggattctggccgaggagatataatagatactttgcttggacccaag

SEQ ID NO: 11105 - DNA, 431 bp, Canis familiaris
  misc_feature (381)..(381): n is a, c, g, or t
  misc_feature (400)..(401): n is a, c, g, or t
  misc_feature (404)..(404): n is a, c, g, or t
acaatagttctggaaccgtgggtatgaaggagatgaaaaggacaagtaaatgtgaattctaattgtcttcaatcaagcagaatgaaaatgaagatgctataactgtgataactggagaggaaaataatttaggtggatagaagttggaaatcataatctaaaaaatgctttgaagagtaaaatatttctcctttgaatttattctggtcactgttgcctgaacactccccccaaagatccatatctatgttcattgtatatgaattaaatcaataccaattatatggattttcccataaatgttagttgtaaatctcttgagccgtaaagttttgatggaaaacacataaaactctagaaaactattggaaatattaaagntaacactttccataagctnntcnttactgagcatagcatattttactttc

SEQ ID NO: 11106 - DNA, 149 bp, Canis familiaris
  misc_feature (84)..(84): n is a, c, g, or t
gaccacttctgagaaaccttaaagcagtctagtggcaactttgtttaagagccaacattcctccagggctgcccagacctcagncgctcaacactgtggaactagcccctctgctgagtctgttgtaggtacctctaattgagtgtgga

SEQ ID NO: 11107 - DNA, 505 bp, Canis familiaris
  misc_feature (218)..(218): n is a, c, g, or t
  misc_feature (236)..(294): n is a, c, g, or t
  misc_feature (298)..(298): n is a, c, g, or t
  misc_feature (300)..(302): n is a, c, g, or t
  misc_feature (305)..(307): n is a, c, g, or t
  misc_feature (317)..(317): n is a, c, g, or t
gaggctcttcacataaattccaatcgtatatgaaattcaggtgtcatggggtcctttgcctgctgaaggtctctctggaagggttctgtttcctctatcttgtattgggagcagtggcttctgttttccattcagatgccctcataaccgggaagagattggcagatgtttcttccccatacaaaaatgctgcagaagacagaagtagaaataagtcncacagagagagagagagnnnnnnnnnnnnnnnnnnnnnnnnnnnnnnnnnnnnnnnnnnnnnnnnnnnnnnnnnnncgancnnnggnnntcaggatcgngccctggaccaaagtgactcacacccctgccccatccactgtttccaacattcataaaaccttgtcacatacaattggcctttggggtgtgggatctcagccaaggaacaagggaccatatcacactgagtctgagaagcaagagacagaagcagctgcaggatccatacctgggatccaaaggcggt

SEQ ID NO: 11108 - DNA, 184 bp, Canis familiaris
gacttgggagatcttgccttgtagccgcttgtctcctgctctacctgtcggacacagtttcaccacagcaagccatcgacagcctgagagacctgcgagggtctggagcaatacagacgatcaagcaatataattatcttcatgagtttcgggacaaactagctgcacatctatcatcaagaga

SEQ ID NO: 11109 - DNA, 526 bp, Canis familiaris
actgactgccatcttcttatttgagaatctggcatccctaacaggaagaaggtggaagattttttttgcggaagaaataaaaaagagcatgatttcattccttctccacctctgggatcctaatcccaagattggagccgcttgctgtgacgtcctgatcatctgcatcccttttctgggtcttcaggaactctatggggtgttagatcatctccttgatggtcaggatctaccacgggccagggatttctacaggcaattctgtgtgaaactggcaaggaaaaaccaggaaatcctgtggatcctccacacccactcattcaccttcttcagcagcaattgggagatgatccggagtgctgcagtcaagctcacagatgccatcgtcctcaatttgaccaaccgatatatgcagttattagacaaagaacaactgaccacacggctccaggcacttcggcaagacccctgtatcagtgtccagagagcagctgaagctgccttgcagaccctcctgagaaagtgt

SEQ ID NO: 11110 - DNA, 36 bp, Canis familiaris
tgtgtcaatggcaagtcggctttgtaaagctgcaat

SEQ ID NO: 11111 - DNA, 350 bp, Canis familiaris
  misc_feature (79)..(79): n is a, c, g, or t
  misc_feature (295)..(296): n is a, c, g, or t
ggcacacttggcacgggtcagacacagtgccgccagtcagagagccacccctgcagcttccaggaggaggagacccgcnctggcacccgcccgccagccgcccgcgccaccctgccctgcttttcctggccaggaggacagtgacatgagcagcggggagactgtggaggggccggcagcagaggatgaagtgctggggccgtgggggccaaggaagccagcctccctgcagccctgctctgggccgttctctcccttaggactgcaacagcaaccacagcccatggggcctccnnaagtggatgacagcagctcggaggattcagacgagattgtcgttgctccagctc

SEQ ID NO: 11112 - DNA, 256 bp, Canis familiaris
  misc_feature (48)..(51): n is a, c, g, or t
  misc_feature (54)..(54): n is a, c, g, or t
  misc_feature (137)..(137): n is a, c, g, or t
  misc_feature (222)..(222): n is a, c, g, or t
gaggctcagggataacttcttcacgtactcttttcaaaaaaaaaaaannnnaanacaaaacctgtttcatacagctgaatattaaagaatatgcagatcatctcaggcaccttaggaattgaacatgttcatattgncccattacctcctcgatgacatgaagataggagaatctgctgacaagcagattcactttgagacctgctactacttcagggtcgngaatttgccttctgccaaacccacgggagtgtta

SEQ ID NO: 11113 - DNA, 488 bp, Canis familiaris
gtactttcccttgcatactcaataaggccttagttggtgacatcaaagagaagctgtgttatgtggccttggagccagagaaagagctatgcaagaggccagaagaggttctgagagaatacagactgccagacgggaatgttatctacattggagaccagctgcaccaagtgcctgaaattctttttgcacccgatcagctgggtattcacaacccaggactctccaaaatggtgtccagcagcattatgaagtgtgacactgacatccaaaataatctttttgcggaaattgtgctgtctgggggcaccactcttttccctgggcttgaggaaagacttatgaaagaattggaacagctggcttccagaggaactcccatcaagattacagcttctcctgatagatgtttttctgcatggataggtgcatccattgtgacctctctgagcagtttcaagcagatgtggatcacttctgcagatttc

SEQ ID NO: 11114 - DNA, 474 bp, Canis familiaris
  misc_feature (231)..(231): n is a, c, g, or t
gatcatcttcgtgatgggcggcccaggttgtggcaaagggacacagtgcaagaacatggcgaccaaatacggcttccgccacgtggggctgggccagctgctgcggcaggaggcccgacgcagcacccagcggggccggaagatctatgacatcatgctgcaggggctcctggtgcccacgggcatcatcctagacctgatcagcagcaccatgctgtctcacccagaganccgaggcttcctcattgacggcttcccacgggggctgaagcaggccaaggagtttgagcgccttgtgggccgggccccagacatcgtcatcgtgtttgattgctccatggatacaatggtccggagagtgctgcaccggggccgggtggagcacagggcagatgactgtgagtcggccatccgccagcgcctggagacctactacatgctgtgtgagccagtcctgaccttctatcagcagaa

SEQ ID NO: 11115 - DNA, 431 bp, Canis familiaris
  misc_feature (30)..(31): n is a, c, g, or t
  misc_feature (36)..(37): n is a, c, g, or t
  misc_feature (130)..(130): n is a, c, g, or t
  misc_feature (135)..(135): n is a, c, g, or t
  misc_feature (201)..(201): n is a, c, g, or t
  misc_feature (228)..(229): n is a, c, g, or t
  misc_feature (297)..(297): n is a, c, g, or t
acagcggtagaagagtccccaggccctctnnaggannaatctccagacaaagttcctgagttggagttagaagaagaaactcaagttcaagagatgaccctcgatgagtggaaaaatcttcaagaacagnccagnaccaaagcctgagtttaacatccgaaaacctgagtccactgtcccttccaaagcagtggtgatacncaaatccaagtatagagatgatatggnnaaggatgactatgaagacgatgcccatgttttccggaaagcagccaatgacatcacatcccagctggngattaatttcggtaacctccctcgtcctgggcgtggagccagaggtggcccacggggaggccggggaaggatcagaagggcagaaaactatggacccagagtggaagtggtgacacaagatgttgctcccaacc

SEQ ID NO: 11116 - DNA, 481 bp, Canis familiaris
agcaattttttcagttccatgcaatgtgctggtgaagttgatctacatacagaaaatgaggaagactatgataaatacggaattcgaattcgagtcaaatttcgcagcagtacgcagctgcacgaattaaccccacaccatcagagtggaggtgaaagaagtgtttccaccatgttgtacttgatggcgctccaggagcttaatcgatgtccatttagagtagttgatgaaatcaatcagggaatggacccgatcaatgaacggagagtgtttgaaatggttgtaaatactgcttgtaaagaaaatacatctcagtacttctttattacaccaaagctcctgcagaatcttccttattctgagaagatgaccgtattgtttgtctacaatggtcctcatatgttggaacctaacagatggaatttaaaggctttccaaaggcggcggcgccgtatcacattcactcaaccttctcaataaa

SEQ ID NO: 11117 - DNA, 191 bp, Canis familiaris
ttctgtatgtttttgaagttctcaacatttaaactaaaggacacggtattactattttaacgtgtatttgacctacctgtgaagatttatatgtagtcttaagcagttagtacactaaaatgaatttttagctgagttttatattgtgattcttaatcttatctgagacaatgtaagagcccttttgaata

SEQ ID NO: 11118 - DNA, 428 bp, Canis familiaris
aactgtcccatagctaccactttgactggtccccgcagggtcacaggagctgatgtcacaattggtgtctgatctctgccccccaaaatggccctggcgagtcattgctgtttagactagaccacaaagctcttcagccaggaactaacatgctgggcaatccaccatctggtcttgaatgaagacagcccagtacccaggactcagggaatagaccaccacacctttcagtaccacctattgtccccagcacacaccaccagctgagcaagaagccccacaatgattgttgtcttatggttgcttctcattgcaggaaccatgtggaagggatataagtatcccccaggagggaccccggtggaagtaagcaaagatgatcctggtgaagtaatgcagctctgaagctcacctgaccagctgtacag

SEQ ID NO: 11119 - DNA, 169 bp, Canis familiaris
  misc_feature (50)..(50): n is a, c, g, or t
  misc_feature (88)..(88): n is a, c, g, or t
  misc_feature (94)..(94): n is a, c, g, or t
  misc_feature (98)..(98): n is a, c, g, or t
tcatgtttgcttgtgaatgtgcctcttaggagcaattgtctgggagtgantggattaagcttgggctgcacaggcagattgtgctccntgaagnccgngctccctgaaagactcagagcagctcagccagcatgtccagagtatgaagcatgaagtacatttattctgc

SEQ ID NO: 11120 - DNA, 364 bp, Canis familiaris
actatcttctattcgtgtctatgagcgaatgccagtggaatccttaaatgcattacttagacagctggagaaagagaaaaggagtcttgaaaatcaagtgaaaaactgtgcacttagactggaacaagagtcaaaggcttacaacaaaaccaatgatgaacgccgtacatatctagctgaaatgtctcagttctctggctcacaccaagtttctaaaaggcaacagatggatcaacttcagaaaataaaagagaatcatgtgaaaacaggaagatataattcagctaatcagaagatagtaaatgccaagaaggtaccagcaaaaaagattacaaaaccaaaccatcttccaaaactcaatccg

SEQ ID NO: 11121 - DNA, 60 bp, Canis familiaris
gagagctgggtccaacgaccaagattaggagacattttgtaacccagaaatacagaaagc

SEQ ID NO: 11122 - DNA, 439 bp, Canis familiaris
gaagaacaccatcaggaagcccagaaggccaaggaggcagacatagagaagctgaaccaggccttgtgcttgcgctacaagaatgaaaaggagctccaggaagtgatacaacagcagaatgagaagatactagagcagatagacaagagtggcgagctcataagccttagagaagaggtgacccagcttactcgctcacttcggcgtgcagagacagagacgaaggtgctacaagagaccctagcaggtcagctgaaccccgactgtcagcctatggccactaactggatccaggagaaagtgtggctctcccaagaggtggaaaagctgagggtgatgttcctggagatgaaaaatgagaaggcaaagctcatggtcaagttccagagccatagaaacatactagaggagaaccttcggcgctctgacaaggagttaa

SEQ ID NO: 11123 - DNA, 429 bp, Canis familiaris
atccagtccccttgctttgagctcatcccagaggaggagtgtgtggaacggttctggtatggctggtgcaaaagctataggcctgtctctgtggccgtgatccaccatcccatccaccatgactgtggggcagataatctgaatgacaagccccccattccgacccaggtggggccggccaccaccaccaccacacccgctgacccagttatgggcacaatcacaagtaccccggattcagcagctcccatcactatctggcgctctgagagccccacagggaagtcccagggccaagttaaatcggaatcttcacctccagacctgagccggtcagtaagcccgagagagttgaccaggatgtcagagtccagcccagatagccggggagacctggagagtgaggacagttacaatgaccccaggcgg

SEQ ID NO: 11124 - DNA, 375 bp, Canis familiaris
  misc_feature (108)..(108): n is a, c, g, or t
  misc_feature (112)..(112): n is a, c, g, or t
  misc_feature (280)..(280): n is a, c, g, or t
ccgtgctggccatctcctgggtgctgggccgcgccctggccctgctcacgtccgtcctcttcgtcctccgacagctgtggaactggctctgggcctggtggacccganggcnagcggtgaagccccagccctgccagagagcccaggtccggaccttcactcggcggaacgacctgtgcgccatctgcctggacgagtacgaggagggcgaccagctcaagatcctgccctgctcccacacctaccactgcaagtgcatcgacccctggttctcccaggncgcgcggcgctcctgccccgtgtgcaagcagtccgtggccggcacggaagacggctccgactccaccgtcgatagcttcggcgacgaggacccct

SEQ ID NO: 11125 - DNA, 444 bp, Canis familiaris
  misc_feature (98)..(98): n is a, c, g, or t
aagactctggatctgttctgtgctcctgcagaagagtatttggctggggtgtcctgtggtgtgagggactggctgggaggggggccaagggcaatcancagccacagaggatggtgccacaaaggagagccttgggggttaggactactgtgctgtcagaaaagattagaaatggggatttctgaggaggaaccgccaagtgctctgccagaagggccaggcctcgagttggaactgtcttgcttgcatttcgtcctgtctacactgttgtacgcatgccctgaagttttcctgaatgatgagacaaaatgtgttttccttggccatttagagcctgtgttttcagagcaaacagtagaaaacaagaaaatgctttcaagtataaaaagtacctcaaaccatctgcagataacactggggttactggctctaccagcttttgaa

SEQ ID NO: 11126 - DNA, 592 bp, Canis familiaris
gaactagacttggagctgctgccaacttcagccaccacagacaacacgctgagaagatccaacagcgcccctttgatcaatgggcttggtgataactcacaggtgttccaaggtgacacattaacaactcgaagaaatagcacaacgtttatgacacaacattgtccggaagaaggtatggatttaataaatagagaagcaatgcatgaatggaaggtacaaactgcaatacagataaatcggtcttgggaagcaagtttgaacctgagtgacggtgatttagagaaaccatcttcaaagtgcatcgatttaattccagtatccccagcaacttctcctaccaggggaattgggaagcaatgtttgcctccatcgttacaaacttgtgtgggttgcaccactttgcctccaagtcctattcctaatcctacacaacgatttacagtaagaagtcaaagccccaacaacactattagaccaagtatctgtggacctttaaaaagaaaaggtgaaatatttgaagatcagccaaagaggagtttctatggcacaaccaacgtggtttcttctgatactacccaacagtctgata

SEQ ID NO: 11127 - DNA, 120 bp, Canis familiaris
atgggttcccattgtgccaagctcggcacaggccacagccggggccacgaatcctccatgaagaagctcatggcctgcgtgagtcaggataacttctccttgtcgtcagaaggcgaggaa

SEQ ID NO: 11128 - DNA, 76 bp, Canis familiaris
gtctggttgccaaggctacgtaaactcttagcagtaaatgaaaatgagtattttaccgaactgcaattgaaagaag

SEQ ID NO: 11129 - DNA, 60 bp, Canis familiaris
caacaaccagaagcgccagaagtgtcgttggcgccaatgcctacagtttgccatgaagcg

SEQ ID NO: 11130 - DNA, 388 bp, Canis familiaris
  misc_feature (209)..(209): n is a, c, g, or t
aaaagttcagtatccaccctggagtcacttacaaaagctgctctgattgcaaaagagacaacccaagtggcacaaaacgcagcccaggttcttgagtcctttgagcacttgccacctctcccagagccaccaccactcctgcctgaactggtagacaaaatccgagacacacttcctccccagaagcccgagctcaaagtgaaacgggngctgagacccaagggcattgccctgacttggaacatcagcaaaatcaatcccaagtgtgctccagtggaaagctatcacctctttctctgtcatgagaaccccaatcataagttgatttggaagaaaattggagaaattaaagctttgccactcccaatggcctgtactttatctcaat

SEQ ID NO: 11131 - DNA, 460 bp, Canis familiaris
tgtatgaagaccctgttccactgttcttgcttcatggcatgggaattgccgaaaagagcttatagccggaagtcctgggacaaccagcagcagacggtggccaagatatgcaagtaccttgtgactacccaccaggacagcgccttcacattcctcagccagagcctggagtatgccaagaattcccgggcctccctccggaagtactcagtcatgttcatagggtccctggtcccttgcatggagagcataatgacagaagaccgtctgaacgaagtgaaagcagctctggaagacctgagacacgacccagaagcattggtgtgcatctatgcagcccaggcccaggaccacatcctggccagctgctggcggaactcctggccgctgccgcacggggactcgtgggtgtgtgacccggtccccacgcaccgctggagccctagctgtgagaacctgc

SEQ ID NO: 11132 - DNA, 548 bp, Canis familiaris
gtccccgagtatcgcaggcgcgtctatcagatgatcctggagcgcaggggtgatggccgcgtccccggagagaagggcctggggggcaccccccgggggacagagcccagtgggccccgggcgcacctgctcaaacccagggccatccatcagctgtctccgggctcgcctgcacagaagccgggacgcagacctcagagcagcccgggtcgccagggcgcccacgccaagaaccttccccggcagagctcggcccccctgctgcagcctccgccgccaggagcgggaagggggcggcgccctccctggcctcgcagaccgccgcccagatcccggccctccgctcctaggcgtccttccctccctcccggccccgcccctgacgccccgcccccccactgtgcgcaggtcccacgcgcgctccccgcggatgccccgcgcgagccccggccgggccggaggatgttcagcgcctcggcctcgcagggcgctcagggcgcggccagggcggcgctcgggggctactctcaagcctacgggaccgtctg

SEQ ID NO: 11133 - DNA, 238 bp, Canis familiaris
aacaggaggcttacagactgctaaaggcttcactgaagtctcaagtcatcagttatggtgactgcagtgaaaaagtggccgaaactttttacaacatgggcaggatctgcttcgccaaaggagagctcagaaaggccattcagctgttacagaagtgtctgatgattcaaatctttttatatggaagtgagcacagtaaaagcagagacacaaaagacctccttaccttgttgcagag

SEQ ID NO: 11134 - DNA, 559 bp, Canis familiaris
  misc_feature (112)..(112): n is a, c, g, or t
ggaactgggtgaatgcatctgtgctccatgccattgctgccacacaggaggagagagccatggcaaaccccaacaggaccgaatggatgcagatccaaagactagaagctgnaggggagagcttacaagaggaaatccggagaaaagaaaccctccttagggaaaagctgaagaagacagaggaggaactccgaaggatccagaaagaaaaggaacaggctaaggaaaatgaaaaaagagagctacagagaatgacactccccaggaggagaattaaaggtaatagcaacaccacatacaaacctaccttctccccagaattcgggtctgaggaggtcttcagtagagacaggggagaagatgaactttggggacagtctcaagaaaattctggtccattccagttctctgattacggaatacagaagctcaaaagggaaagactggtggcaagcaataacagaatccgagacctagtctcagagtcatcaaaggagttttctcagtcttcagaaggcctggcagtgttttgtggggatccaccagcaattctagtttg

SEQ ID NO: 11135 - DNA, 384 bp, Canis familiaris
gtaaccaggaaactaccacagcccaatccagttagggagcaactaactatgagtttcagtgagaggagaaagatgaagactccctttgagcccaggaccagaggtggtggcaaggtcctgaagccaacactgaaggcaaaaagaccccttcacaggagtttgagcaaaagaattccagaaaaatctgccaactctgtgagaaatgctaagaaaactagaataataacactattcggtcactatcacagactgaatgagatgctgaatcaaaatgagcaagagcgagagcaagaccaggaccaggaccaggaccaggaccaggaccaggaccaggaccaataccaataccaataccaagagaatgtggagaagtccaccacctca

SEQ ID NO: 11136 - DNA, 281 bp, Canis familiaris
  misc_feature (66)..(66): n is a, c, g, or t
  misc_feature (127)..(127): n is a, c, g, or t
  misc_feature (129)..(129): n is a, c, g, or t
  misc_feature (139)..(139): n is a, c, g, or t
  misc_feature (180)..(180): n is a, c, g, or t
  misc_feature (249)..(249): n is a, c, g, or t
atgctgtcccaaggtatatccatgctgtactcctttttcatgccagctaccaaactcagggaacgnttggatcagccgatgacagaaattgtgagccatatgtcaaagcgaaagctgggccaccatntncgggcactgntccttgagctgtgctgcaatgatgagagcggtgaggatgtngaggttccctatgtacaatataccttccgctgatttcccagtctctaaacagtcccttctagttgtggnaaaacaagtgcctaaccttatatccttttgag

SEQ ID NO: 11137 - DNA, 159 bp, Canis familiaris
tggacctgcgagctctgctgttacagataccatgtcatagccattaaaatgaaacaaccttgccagtggcaaagcatttctataacactggttgagaaagttcagatgattgctgtaatcctaggatccctgttcttaatagcgagtgtgacctggctc

SEQ ID NO: 11138 - DNA, 531 bp, Canis familiaris
  misc_feature (333)..(333): n is a, c, g, or t
  misc_feature (336)..(336): n is a, c, g, or t
aagagctacgcgcagcctgaggttctgcgtcgcacctttgagaccttgtccagcctccacaggctgctgcccagtcggctcgtggacaccctccattcctacaagacggaggacaagcaagactgtcagaatcctgaattctctggcttagaaaggatcttagcacgacatcaacttccaaaagagattaatgcgaccccaaagccaagtagcatacccctgtggagaagaaaatccatcaacaatgcaaatcgtgggtggaagaaatgccatttatggaaaaaaaaaatggaggagcctccaatgtcaaccatagttgtcagatggttgaanganaacatgcaacccaccgaagaccttcagtcagtaatccagaggctgtccgtgtttgggccaattaagtcagtcaccctctgtggacggcaaagtgccatcgtggtgtttgaagacatgatttcagcctgtaatgctgtgaacgcttttcaaagcagggcccctggcacaatgtttcagtgttcctggcaacagcga

SEQ ID NO: 11139 - DNA, 300 bp, Canis familiaris
gctgccattacccagaatgttgagagaaccaggccacggtgatgcccattcccaggagcatcctcatggcttccaaaacatgaggttccattatgagcgcaacccagagactgatatgatgacagagattggcctagaagagctcaatggactggagatggaagtcatgaaaaggcagctgcaggtgatcaccagccgcctgcgagccctggaggaccagggcgccacctggcgccacagggaagctctgttcttcaccgtgctggtgtcggcctgcattgccaacctgtggctgtggat

SEQ ID NO: 11140 - DNA, 495 bp, Canis familiaris
acactgctgtgtgtacttcgtgccgcccactgggcactgcctgcggcccttggacattgagttcctacagcggctgtgccgggccgtgaacgtggtgcctgtgatagcccgggccgacagcctgaccatcgaggagcgagagaccttcaggcaaaggatccagcacaacctgaggagtcactgcatcgaggtgtacccacagaagtccctcgatgaggacaccaatgaccggatccttaacagcaaaatccgggaccggatcccctttgccgtggttggggctgaccgagagcacctggtgaatgggaagtgtgtcctgggccggaagaccaagtggggcatcattgaagtggagaacatggcacactgtgagtttcccctcctgagggacctgcttatccgctctcacctccaagatctgaaggacatcacccacaacgtgcactacgagaactaccgtgtctgcaggctcaatgagagccacctgctgcctca

SEQ ID NO: 11141 - DNA, 304 bp, Canis familiaris
  misc_feature (28)..(28): n is a, c, g, or t
  misc_feature (46)..(46): n is a, c, g, or t
  misc_feature (70)..(70): n is a, c, g, or t
  misc_feature (77)..(77): n is a, c, g, or t
  misc_feature (127)..(127): n is a, c, g, or t
  misc_feature (230)..(230): n is a, c, g, or t
ccatccatgtcaatcggacctttgaagnactgtccttgtctgaagncaagaagcttagttcctacttccnccttagngagcctgttgagctgaagaacaagaccttacttgagaaggctgacctggncccctccctggacttcatggactccttggagcatgacatccccaaagggtcctggagcatccagatggagaggggcaacgccctggtggtgctgcgcagcctnctctggccgggcctcaccttcttccatgctccccgcaccaagaactatggctacatctacatgggcactggtga

SEQ ID NO: 11142 - DNA, 491 bp, Canis familiaris
cttccgaggcaggacagtgcagcttcagtcgagaggagctcgagcagatccttcaggagcggaatgagctcaaagccaacgtgttcctgctgaaggaggagttggcctacttccagcgggagctactcacagatcaccgggtccctgggcttctccttgaagccatgaaggtggctgtcaagaagcagcggaagaagatcaaggccaagatgttagggatcccagaggaagcagagagcagtgaagatgaagacagctcatggctcctgccgtctggcaataagggggcccaccctccacccactgaatccagaatccagcgtttctttggcctgtcctatcagggtgaaacagaggcccctgaagcccagaccagcacggtgcccagtgagctaaggggagaagaggaggctctacaggaactccatatgcggcctgtgggcagccagtcctcaattcctgactggctctgctctgcacttgatgaacag

SEQ ID NO: 11143 - DNA, 489 bp, Canis familiaris
cagtgaggactacctgtccctggaggggccccgctgggcaccggccatcaaacaggcaacacgctggaagtacacacccctgggacgtgacgcggccggccagctgtggtacaccggcctaaccaactcggactcccgcgaggcctggtacacgctcccgcgggccccggacagcccgtaccgggaggcctatgcccgctggcacggatgtcacaggcaccgggagcgaagcatgccctcggcctatacccagtgcctccgggagaccgcttggcatgaccccatcatccctgcccagtacagggcccccagcacgcagtgggggagcatgctctggaaagacaggcccatccggggcaaggaatacgtgctcaacagacaccggtacgggatggagccaccggggccggcctctgactacgtgccgtacctgtcggtgcctcagcgcccgcgctacaccacccagaactaccggcagtgggacctgga

SEQ ID NO: 11144 - DNA, 162 bp, Canis familiaris
aggaatgatttctttgacgctggcatcaccaaggcccagctgttcctcaccctccacgacgctgtgctgtttgccttgtcaaggaagtttccagagtcatccgagttaagcatggacgaatctgagacagtgatacaggaaaccttctcagaaacagacaag

SEQ ID NO: 11145 - DNA, 281 bp, Canis familiaris
  misc_feature (241)..(241): n is a, c, g, or t
aacagtggaagtctcagaaggctctgcttctcttcagcagtaaatgggagaataatttgatacaaaccagaactaaaacctttacatctcccacatctgcctgcagaacttaaatcagtgaagagactcattgctaagcagcaggaagcaaaaggaagcttcggcttcccactaaattaccatgttgggctggtgtgcctttctattgccctcagaactggtgggtgaagacacttgagangtagcaagtgggctatattaaatctctcttctcgcaaaaa

SEQ ID NO: 11146 - DNA, 353 bp, Canis familiaris
  misc_feature (40)..(40): n is a, c, g, or t
  misc_feature (79)..(79): n is a, c, g, or t
  misc_feature (98)..(98): n is a, c, g, or t
  misc_feature (224)..(224): n is a, c, g, or t
ctgcttggctgtgccagtaagggtctagatatagaaagcnctagtaaaagggtctacaaacaggcggtttttgatttancaaaagagatttttgaggnaaatattcgcagaggatcccaacttgaatcaacctgtctggatgaagccatgtagaatcaactctagttatttccgacgagtgaaaaatccaaataaccttgatgaaatcaagaacttcatagccncagaagtactcaagttgtttagtcttaaaaaggagccaaaccacaaaacagattggcagaaaatgatgaaatttggaagaaagaaaagagaccgagtggatcatatcctggtccaggagctccacgaag

SEQ ID NO: 11147 - DNA, 549 bp, Canis familiaris
ctgagttcactgctggcctatcttccgagctgcgttctgtcctcaccatgatgctggaacctgaccccaagctgcgggccaccgctgaggccctgctggctctgcccatgctcaggcggcctcggccatggagcattctgtggtacgtggctgccgatgccctcagccgagggtgggccctgtggcaggccctgctttccttgctgtgctggctctggcacggattggctcaccccgccagctggctgcagccgccgagcccaccagccaccccgcctggctccccaccctgcagcctcctcctggatagcagcctctccagcagctgggatgatgacagcatagggctctcactctctgcagaggctgtcctggccagggctactgggaacacctccaccccccgcagtggctcccccgccccccggaacaggtacacactgagggatgccctggacctgagtgacattgactccgagcccgctcggggctccttcccctccttcgaacctcggaaccttctcagcctgtttgaggactcactgggcc

SEQ ID NO: 11148 - DNA, 399 bp, Canis familiaris
  misc_feature (114)..(114): n is a, c, g, or t
gcctgagtttcgaggacttcctggacctcctcagtgtgttcagtgacacagcaactccagacatcaagtcccactatgccttccgcatcttcgactttgatgatgatggaaccnttgaaccgagaagacctgagtcagctcgtgaactgcctcacaggacagggcgaggacacacgacttagtgcctcagagatgaagcagctcattgacaacatcctggaagagtccgacattgaccgggatggcaccatcaacctctcagagttccaacacgtcatctcccgttcgccggacttcgccagctcctttaagattgtcctgtgacaggagccgtggcgtgtgtcccagcaagcaccctgtcagagagccttcccactgctgagctgtggccgaggtcat

SEQ ID NO: 11149 - DNA, 491 bp, Canis familiaris
  misc_feature (32)..(32): n is a, c, g, or t
tgaagaagcaaagcctcctaaaggaaagagtnttttgccccagagccccgaagatttgcagatgaatcagggctttaataaatacgatctgtctgcattctgcagctcttacaccaaaagttccttgacgcttattaactctgctttagatcaagatttaaatataaatgctgtagcaactagtgaacataaaataattccaaaagcagaaattaagtcagaaggtgcagatgaactgaaggcgggccctgagagcgaaagcagtcatgttttttgtgcttctgtgaccgcagagcccctggcagccgatgatgcagaatccagtgttatcctgccgtctcgggaactggctactgccagtcaaaatgtggaaaacattttccaaatctttaaaatttcagaagatgtaaacataaagtatgaaaaacaggatgactttttcatagctacagaaggaaaagtgcagaccatgcatttaacgtctgacttcc

SEQ ID NO: 11150 - DNA, 349 bp, Canis familiaris
cttcaggcttactacaaccggtacagtgtgcaggagatctttttgagccccatgtacctgggggcttcatcctatgacatcgccctgctaaagctatcctcctctgtcacctacaataagtttgtccagcccatctgtgttatgatctcctcctccgagttccagaaccggaccgactgctgggtgactggctggggggacatccaggaaaatcaggcactgccatccccctacgtcctccaggaagtgcaggtcggcatcataaacactgccatctgtaactacctctacgcacagccgactttccgccgtgacatctggggagacatggtttgtgctggcaaccccc

SEQ ID NO: 11151 - DNA, 256 bp, Canis familiaris
aaagagctccgctacaccctcaatgggaagacaagcaccatccccacccatggactgcaagtcaatatcattgactacaccctgtcacggttggagcgggatggaattgtggtgttctgcgacatttccatggatgaggacctatttacaggtgaaggtgactaccagtttgagatctacaggctaatgaggaaggagaacaacaactgctggggtgaatatcatccttataataatgtgctctggctccattacc

SEQ ID NO: 11152 - DNA, 269 bp, Canis familiaris
acccctcatcctttcgagggcatatgagagtgcacactggagagaaaccttatgaatgcaatcagtgcggaaaaacgttcaactggcccatatctttaagaagacatatgaggacacacatgagggagaaaccctttgaatgcaaacaatgtgggaaagccttcaatttgtctgcctgcttccgagaacacgtgagaatgcaccctggagacaaatcgtatcagtgtaagctgtgtgggaaggcgttctattgccacatatccttacag

SEQ ID NO: 11153 - DNA, 563 bp, Canis familiaris
actgccacggcaacttctcggagaagttctctttctaccgccatcacgtgaacctcaagtcctggtgggtgggcgacatccccgtgtcgggctcgctgctcgccgactggagccgggacaccatgaaggagctgcacctggccatccccgcggagatcacccgggagaagctggaccaagtggcggacgccgtgtaccagaagatggaccagctgtaccaggggaagatgtatttccccggatattttcccaacgagctgcgagccatcttccgggagcaggtgcatctcatccagaatgccatcatcgaaagccgcattgactgtcagcgccactgtggcatcttccagtacgaaaccatctcctgcatcaactgcactgactcgcatgtcgtctgctttggctacaactgcgagtcgtcagcacagtgggaaacagccgtacagggcctcctcctttacataaataagtggcacaaacaggacaccaaaacaagtctgatatcaccaagctttacatgtcttgagcccccacacctggccaacctgactctagaaaatgct

SEQ ID NO: 11154 - DNA, 139 bp, Canis familiaris
gggccaccaggagtagagaatatatccaggcaggtcctgctgcctgcgggcttcatgccctaccccccctatcccccgtgcccaccaggcaggaagggggactccagaaactttggacacccaggcctgcggagcacct

SEQ ID NO: 11155 - DNA, 436 bp, Canis familiaris
attcttcagcaaacatcagcctcaggccttgaacttcgggggcattgggatggtgattgggcatgagatcacccacggctttgacgacaacggccgtaactttgacaagaatgggaacatgctggattggtggagcaatttctcagcccagcacttccgggagcagtcggagtgcatggtccaccagtacgggaactactcctgggacctggcggacaaccaaaacgtgaacgggttcagcacactcggggaaaacatcgccgacaacggaggggtgcggcaggcatacaaggcttacctcaagtggatggcagaaggcggcaaggaccagcagctgccagggctgggactgacctacaaccagctgttctttatcaactatgcccaggtgtggtgtgggtcctaccggcctgagtttgccatacagtccatcaag

SEQ ID NO: 11156 - DNA, 325 bp, Canis familiaris
gtcaggtcgccaagcaacacgtgcaggacggccggaaggaaaacctcgaaggctttgtgaagactttcgataaagaactttcagaagacgcccacccggggatttacgcccttgactgtgaaatgtcctacaccacgtatggcctggagctgacgcgtgtcacggtggtggacacggacatgcaggtggtttacgacaccttcgtcaagccggacaatgaaattgttgactacaacaccaggttttcaggggtgactgaggctgacctcgccgacacgagcatctcgctccgggacgtccaggctgtcctgctgagcatgttcag

SEQ ID NO: 11157 - DNA, 548 bp, Canis familiaris
gtggctagccagacagaagacctgtccgtgctgcaggaaagaagtgaaacggaaaaagatggtccatgtaaataaactccggaggaccattggccgcctggaagtcaagtgcaagaacgcggaagctggctgctcggtgacgtgccccctggcccatcgaagggggcaccaggactcatgcccgttcgagctgatggcctgcccccacgagggctgcacagcacgggtgccgcgtggggccctggccgagcatcggcagcactgcccacacggggcccaggatcgctgcccgctgggctgcggggccaccctggggccggtggagcgtgcgcgccacaactgctaccgcgagctgcgcgaggcctggagccagcggcaggagcgcagccggaccctggtgctgggcctgctgcggcgcatgcgcgaagtgcaccgcacggccaatctcgtccgcagacagctggcccagctcggaggcttcctggaggaggaggacgtgatggtcgtgggcgccccgcaaggggaggccgaggccaccccagaaggca

SEQ ID NO: 11158 - DNA, 578 bp, Canis familiaris
gtatgaaggctggttcctggcgctcttcaacctgctctacagcacactccccatcctctacatcggcctgttcgagcaggacgtgagtgccgagcggagcctggagctgcccgagctgtacgtcgctggccagaaggacgagctctttaactactgggtctttgtccaggcccttgcccacggcatggtcacctccctggtcaacttcttcatgaccctgtgggtcacccacgactcggctgggcccatcagcttcagcgactaccagtctttcgcggtggtcgtggccctgtcgggcctgctatccatcaccatggaggtcatactcatcatcaagtactggacggtcctgtccgtgctggccatcgtcctcagcctcttcttctatgtggttgtaacttgggtcacccagagtttctggctcttccaaatctcacccaagaccttcccgtttctgtatgctgaccaaaacgtgctgtcccacccctccatcctgctggtcatcctgctgaatgtgtcactaaacaccttgcccacattggccctgcgtgtcatttaccaagccctcaagaagcctg

SEQ ID NO: 11159 - DNA, 170 bp, Canis familiaris
ctgctggctagtgggcggtccttcccgtgtgtgctggacaaagccctggtggatgacatcaaggaaaagctgtgctacgtggccgtggagcctgagaaggagctatcccggaagccagaggaggtcctgagagagtacaagctgccagacgggaacatcatctgtgtcgg

SEQ ID NO: 11160 - DNA, 280 bp, Canis familiaris
tgtcagacgtcacacaaagctgccgacagacgaacgtccaagaagttcaaatgtgacaaaggtcacctggtgaaatcagaattacagaaactagcccctcagagtgaccgtgttgctgtgcccagaataccacccgagagccctggtaacagtgagcctctggggtttgccaaagagcacgcgctgcccccaggaaagggggctggagctcctgcacagccggaggccgcggggtgccccctcaggcacgccacagctgtgggcgacacttgcccagcag

SEQ ID NO: 11161 - DNA, 322 bp, Canis familiaris
ctgatatgtttgtcccttttgcttatccctactgcagctgggacgtactgcgagtgcagccttggcctcagccgtgaggccctcatcgccctgctcgtggtgctggcgggcatcagtgccagctgcttctgtgcccttgtcatcgtggcagtcggtgtcatgcgagccaagagtgagccatgccccagacacagggacagcaggttggtggggcactttggggtccaggaagatcacatggacctgcactcagtgcaggtggagtcccaactcatggaccctgagctggaggtctccatgatgacgcccctggaggatcaag

SEQ ID NO: 11162 - DNA, 584 bp, Canis familiaris
tgtccacccacttctgggacgaggacccgcggggcctgtggaccctgggcctggaaaacaaaggctactatttcaacacggggacgctgtaccgctacacgctgctgctctacgggactgccgaggacatgacggcgcggcccccgggcccccaggtgaccagcagcgcgtgtgtgcagcgggacacagaggggctgtgccaggaatgccacagctctgcctacaccctgggccacctctgcctttcctactgccctccgaggtactgcaagcacacccagcaggcggtgaccggcgggcctgggcgcccggccacacccgcgctgcacgtctgctccagctgccgcgcctcctgctgcccctgccgcggcggctcgccgctcaactgcaccgcctgtcccccgtcgtactcgctgcgtgagcatcggggctcctgctcgggacctgtgcctcccaacagccccccccagcccaccgcagtcggccaccccaggtgccaccgtggccgtgcccaggctgtggtattgacgctgctggccgtggccttcgggagccccttactgtgccgcatcctctacaggctg

SEQ ID NO: 11163 - DNA, 109 bp, Canis familiaris
tccagcagggcgctttcggcaactcccagatgtacaacaacaactttgggcccaacttccggggccctggaccgggagggattgtcaactacaaccagatgcccctggg

SEQ ID NO: 11164 - DNA, 426 bp, Canis familiaris
gaatgacccaagatatatgatcctcaacgagcccttcaagtccgagatccacaagggcaattacttggagatgaagaacaagtttctggcccgtaggttcaagctactggagcaggcgctggtcatcgaggagcagctccggagggctgcctaccttaatatgacccaggaccccaaccacccagccatggccctcaacgcccgcctggccgaggtggagtgccttgctgagagccaccagcatctgtccaaggagtcccttgctgggaacaagccagctaacgctgtcctgcacaaggtcctgaaccagctggaggagctgctaagcgacatgaaggcggatgtgacacgcctcccgtccatgctgtcccgaatcccccctgtggccgcccgcctccagatgtcagagcgtagcatcctgagccg

SEQ ID NO: 11165 - DNA, 347 bp, Canis familiaris
  misc_feature (61)..(61): n is a, c, g, or t
gatccctgggtctcacagaagagcaactgagacagcagctcacagagtggcaggacctccncctgaaggagaatgtccctccttctctgttgcttctgtcacgaaccttctacctgatagatgtgaagccaaagccaattgagataccactaagtggggagtctcccataacagatactcctgtggaatcacctacttctcctgaatctaaagagacgctggtggatttagcacctccactgaagggaactcaggatgaaaaatttatacaactgccaccagttccatcatcatccataacaccaacacctatttcgttacctaaaggacccatcacttccgctaaa

SEQ ID NO: 11166 - DNA, 510 bp, Canis familiaris
aggaaaacctgtgccgcgcagagcgcgagcgccgggcctccgccaacctgcgggtgctcatcgactgcatcctgcgggacgtggccgaggacctgcggctgcagtgcgacgccgtgaacctggccttcgggcgccgctgtgaggagctggaggacacgcgccacaagctgcagaaccacctgcacaagacgctgcgggagatcaccgagcaggagcacaacgttgcggcgctgaggcaggccatcaaagacaaggaggcgcccctgaaggtggctcagacccgtctgtaccagcgctcacacaggcccaacgtggagctgtgccgggacgctgcccagttcaggctgatgagcgaggtggaggagctgaacatgtccctcacggccctgaaggagaagcttctagaagcagagcagtcgctgcgcaacctggaggacacgcgcatggatctggagaaggacctggccgtcaaggccaacagcctcttcatcgaccgccagaagtgcatga

SEQ ID NO: 11167 - DNA, 233 bp, Canis familiaris
agtgccgattccgacactgtgaagaggctcttggcagtgacactgtatgctcattatggagagagggaaaatgtttagatccactttgcagatttagacacatggaaatgcagcaaaactgcagcatttcatgcttctgggaaactcagcctcttggttgtgtgaagatcagttgtatcttttatcacagcaaacctcgcaatatcaatggattatttttgccaccaagtagc

SEQ ID NO: 11168 - DNA, 432 bp, Canis familiaris
gaatacagtccaatcctcagaagctctgggaagatgacccagaattacctccgatctgtggttctttagcacccactagtgggcatttattgaacagtgaggataaaatagatgaaaatcattttacaaaatctcacagtgaatcatcaccccacattcagctagtgggaaatgtgggacagcttcatggtgtcacttctgtaaagttgtgtcgtaaagagttacgtcagatttctgccttggaactatcattacggcgttctagtcttggagttggggttggatctatgactgctgattccattgaagtagctaggaaaccgagtgacttaaaaacttaggcttttaataatagaacttttaatttagtagaggcataagattcttttgtctgacctgttagaaattaaggcatatgctcactagctcttc

SEQ ID NO: 11169 - DNA, 581 bp, Canis familiaris
agcggtgatagatgctctctcaatcaacaattccactcctttaactagagccatcgagagctgtagactggatactgtaaaatacctccttgatattggggctaacttccagctggaaaatagaaagggacataccgccatggatattgcaaaggcgtacgctgactatagaataattagtttgattcaagaaaagttggataacttgccaaaaccagcagaaaatcaaaaactgaaaggcaagccacctcctaaagtgaagagcgaaggccttgaaattaagaaagaagaggaaccacttgtatcagtttattctgtgccaactgtatcagaagaaaagaaaaaacgtaaagacaatgtggtttatctcaattcattgattaccagtggtcataccaagaaagtggatatcacatttattccacggaggacctggagtcctgaagccacaacagcagagctgatcaggaaaagggagttgcggcgagagaggttcagttatgaggtggactttgaagacttcatgatgccctttcagaagaacatcacagaaaaagctaaagccttagaagccaccttca

SEQ ID NO: 11170 - DNA, 118 bp, Canis familiaris
gattctcacagtcaagctgcttctgggccggagatgcagcctgaaggtgtctgggcaagagagcgtggccatgctgaagaagctggtgtcggaacgactgcaggtgcccgaggagcag

SEQ ID NO: 11171 - DNA, 118 bp, Canis familiaris
acttctcagtgtcttgttttctttttgtcatctgtcctgagaaggagatcagaaagcctgttgctacttacggttgcctgccatggtatttagatgtaacacgtattaaatcggtatt

SEQ ID NO: 11172 - DNA, 119 bp, Canis familiaris
caatctcaggaactcgagaaacctccggacagcaggcctgcagacagcttcccagggaagagaggggcacccaagcggctgcgaccttcctcgtccgaagtggaagagaaacctgatgt

SEQ ID NO: 11173 - DNA, 263 bp, Canis familiaris
aggcctgcagacagcttcccagggaagagaggggcacccaagcggctgcgaccttcctcgtccgaagtggaagagaaacctgatgtaaaggtaacgtcgagcaagaagaaatttgccattccacagatcatcatcactagagcctctaaagagactctagccagctacagttccatcggaagcgaagagcagagaaccattcaggagcaggttgaatggggcccctactaccgacatagaaaccccagtacagtagatgccta

SEQ ID NO: 11174 - DNA, 493 bp, Canis familiaris
tccagcgccctacgttggaaaacgatgactcctacctggggaaactccgggcttccaagaaactgccatataagaacccaactcaccttgctcagcaacaggaaccctggagtcggctcagctcaactcccacaatcacctccacgaggcgggatatttattttcttgatcctgagataccaaaggatgacctggatttccgcttagcagccttgtacaaccaccacacagggacattcaagaacaaaagtgagatacttttacaccaggagaccacccaggatatccatggaatcatcaagacccaattccctggagaacttttaccccctcctccgccaccttccgtcacttcccgagctaacatcagacactggatcaaccctaagaaggagtctatccacagcatccagggatccatagtgtcccctcacactgctgccaccaatggaggctactcccgaaagaatgatggtggcttcttctctactta

SEQ ID NO: 11175 - DNA, 129 bp, Canis familiaris
gtcggtgtgtctcgccttcgatcaactgcgggacgtgatcgaatctcaggaggaactgatccagcagctgaggaacgtgatggttctccaggacgaaaattttgtcagtaaagaagagttccaggcagt

SEQ ID NO: 11176 - DNA, 120 bp, Canis familiaris
  misc_feature (27)..(27): n is a, c, g, or t
ctcggagaggttgaggtgctgtctaancagctggagaaagagaagctggcttttgaaaaggcgctctccagtgtcaagagcagagccctgcaggaaaccagtaagaaggaccagcttatc

SEQ ID NO: 11177 - DNA, 134 bp, Canis familiaris
ttcctacaggaaatattcatatgttttcaaatgtgacagatgatacccactattaccgccggcagcatggacgtgagaggatgcagacacggaaggaagaagaagataagcctcagactacatattctgcattt

SEQ ID NO: 11178 - DNA, 241 bp, Canis familiaris
attgtcggctggattcaggcgtgcagccacatggagttctacaaccagtatggggagcagggcatgtccagctgggagctcccagacctccaggagggcaagatcgaggccattagtgactcggacggggtgaactacccctggtacggcaacaccacagagacatgcaccattgtaggccccaccaagagagactccaagttcatcatcagcatgaacgacaacttctatcccagcgtca

SEQ ID NO: 11179 - DNA, 573 bp, Canis familiaris
ggactttgaagctgatatcactccagaagagttattcaatgtcttctttggaggacattttcctacaggaaatattcatatgttttcaaatgtgacagatgatacccactattaccgccggcagcatggacgtgagaggatgcagacacggaaggaagaagaagataagcctcagactacatattctgcatttattcagttacttcctgttcttgtgattgtgattatatctgtcattactcagctgctagctgctaatcccccatatagtctattctataaatcgaccttgggctacaccatctctagagaaacacagaacctgcaggtgccttattttgtggataaaaactttgagaaggcctacagaggagcatctctccgtgacctggagaagacgatagagaaggattacattgattatgtccagacaagttgttggaaggagaaacaacaaaagtcggagttgacaaatttggcaggattgtacagagatgaacgattgaaacagaaggcagagtcactgaaacttgaaaactgtgaaaaactctccaaacttattggcctgcgcaa

SEQ ID NO: 11180 - DNA, 550 bp, Canis familiaris
  misc_feature (129)..(129): n is a, c, g, or t
cagtgacaagctggcccgctgggctgtgctgggactgggtggcgggctgcttgcccactttctgcctcccctctatgccaccagccttgtcctggccgacccctgccatgaccccccaactctgagcanagccatccacacccggcccagcctagacagggtcctggggccgtgcctgccgcccccctatgcccgtaccacgctgcacctgtttgcggggccccctgtggcccccttggatcctatccccaacacctgccatagcctgagccttaactggagtctgggggacaccgatgtcgaggtcgtggatgtggccacagggcgtgtgaaggccgatgctggcctggggcccccctcccgcctctgcaaggcagcctttctcagggccttccgccaggttgccggagttctggggaagtcccgcctcctagccttgaagacctatgaggcagccaaggctggaccctaccaggacgcccgcaggcagctgtctctcctcctggaccagcagggcctgggggcttggtcctcgaaaccactggtgggc

SEQ ID NO: 11181 - DNA, 112 bp, Canis familiaris
agccacctgcaaaggctcacggacttgcttgctcttccaggacctgccggacttggaggacgctgatgtgggcgaggctctggacggccaagatgagatgtgctttccaaag

SEQ ID NO: 11182 - DNA, 225 bp, Canis familiaris
  misc_feature (161)..(161): n is a, c, g, or t
atgtgctttccaaaggtgacagccatctcgagcttgagtgatgacagtgaacccgaactggattactcctcactcccagtcctggaagacaccccagatgcgctttcaaacatattcgcaatccccagggacacctccaggaaggctgagacaccctttanagacatatttaaagcagctaagaggaactcggaaaccccaagtagagacaccaagtccccacgc

SEQ ID NO: 11183 - DNA, 493 bp, Canis familiaris
  misc_feature (408)..(408): n is a, c, g, or t
  misc_feature (427)..(427): n is a, c, g, or t
  misc_feature (430)..(430): n is a, c, g, or t
  misc_feature (453)..(453): n is a, c, g, or t
  misc_feature (462)..(462): n is a, c, g, or t
cttatgcattccttccaaaattggatcatttaggtcaaattatttgatgttaaatcataagttttcatttgcttacatttacgatatcagcgtcagctacggaatcaatctgctgaaggaccgtggctggcggcgtgtacgatccagcaaccagcgcctgggacccgacttcatccaggaacccctcagaagactccactgacattaggaagactcataagaaccttacaagaaaaagtatcaaccccatcaaaacggcagaaaagaaacatatcttgttattagtagctgaaattccattttctacatgttgccataccttataaaaactacactaagctacgcttaaggaaatacattttcttaaataaattagaattgaaaccaatttttaagtaaatctagggnttcaatttattctcattgngtnttgtttctggtgcaatcatgaanaacagcatnctattaaccaaccttggtcccatgtacataa

SEQ ID NO: 11184 - DNA, 431 bp, Canis familiaris
  misc_feature (54)..(54): n is a, c, g, or t
ggacttgcctccttcaaagctaaaaatgatccagctcctatcaggagttgctcncctcatctgaaaacatctgttgttttccatgctctgaaggcggtgaccactgtttctgcgatgtgacgtccatgagtatctgctaggtttgcagctgagggctccaagccagcagatagggtcacttcctctgcgggccaaggaaacactgagattacttcagcaaaaagtaatttttctgcccctctgtatcatcactcaggcagccggttgagttaaaaaagaaaactgatatgttgtgaagaagcttgatgaaacttttgcttgatctttttatatctggatgcagtaatatggagttaggttatttcctcacatgcttgtcacctgctttgcaattgctttcttacttatttgcctgctccataagattgtaa

SEQ ID NO: 11185 - DNA, 557 bp, Canis familiaris
  misc_feature (241)..(241): n is a, c, g, or t
gtgtcagagcaatgccacaattctccccagtgtccccactgttctttccttccagacctgaggggccagtcatcatacttccaggatagtcttaagaagattttgctccatcagatacctgccgcggggaccctgaggaaagatcgttcacaattcaccctcaagaaaggcaaccacaggtcccacaatatacaggctcctaagctcaagactgtgctcacccacagctcctcaggggaanaggtagggcggtgcaggcggttttgccccttccgagtgcgatttgctgatgaaaccctgcgggacacagcactccgctactgggagcgcaactgtgcagtccggcagagcaacatcgagaatgggatagccacccgatcatcgacatcagaacgggtgtccgggagtgtcgggagatggctggagagtttgcccaaagccctaagccccagggcccaggaggaggccatggccagcgtctcgttgttctgctgggagtgccccggcctgcccacccaggagccacagagtcacctgtctgaggatgccttcatgaa

SEQ ID NO: 11186 - DNA, 206 bp, Canis familiaris
ggctccttgaagttcgtggaagactttatgagcttctaactcattgtattcctcctgaaataataatgaagggccttctttcagaacttttgcataattgtgatggacagctgaaaggggaagtggcccagatggcagcttactatgaacatcgtctacagctgggtagcaaagccatttatcatttggaagcatttgtggccaaa

SEQ ID NO: 11187 - DNA, 472 bp, Canis familiaris
  misc_feature (228)..(228): n is a, c, g, or t
agacgatctctcttctggtgggcatcttctctgtccttaacaccatccagttcctcatctttgacttgaaccacattacatccattggctacgaggaaaaaatcgacatctacatggacacaaaatcagaggtaatatcttggatcatgatccagaagaagtctatcagcattgtcttatctaccatgaccatcctgttcagcgtgttccttctctattgcatccgcntgaacaactacgtggggctgctgtgttatgctgtgtggatcatcacctatgagctcatcaacttctccatggtcatactcatcaacgggatcatcaaagagcagttcaaggagctgagttacctgaacttgatcttccaaatctcccatatgcttctgcacttcctctccctgcctttcatctctaagcatatctacttcctttacaaggaccctaagactttaagtaagataggccgccgcag

SEQ ID NO: 11188 - DNA, 431 bp, Canis familiaris
  misc_feature (26)..(26): n is a, c, g, or t
  misc_feature (42)..(43): n is a, c, g, or t
agccggaggcccagaaagatcgaagnagcccagggccagagnnggaggcccagcacgaccgaagctgcccagggccagagccagaggcccagcaaaactgaagccgcccagggccagagccgaaatcccagccagactgaagccacccaaggcccaagacaaaagcctaacaagaccaatgctactcagggctcaaggcagaggttcagaaagatcaaggcttcccatggccagagctggcgacccagtaaggctgccacccacggccagagcaggggattgatccggagttccagcaagaccaaggatttctatgatccaagttggagccccagcaatacagagaacactcaggaccaatcccaggggcctagcaagaccaaggctgcccagagctggagccaaaacacaagtccgggttcaagcaagac

SEQ ID NO: 11189 - DNA, 152 bp, Canis familiaris
cagtggcaaatattgacaagtatctttgtatctgtgaaaattagttaattttgtgggtctggcacatttattggttgtgtaaatgttttccagattcttatattcactgtcaaactgctacaaaaaactaaaaagtgttctctgtaacacat

SEQ ID NO: 11190 - DNA, 597 bp, Canis familiaris
caaacggccctatcagaaagactgtgtgcttattattaatcatgacactggtgaatatgtgctggaaaaactcagtagcagcattcaggtcaagaaaacaagagccgaggggagcagtaaaatccaagcccgaatggaacagcagcccactcgtcccccacagccatcacagccaccaccacctccaccacctatgccattcagagctccaacaaagcctccagttggacccaaaacttcccccttgaaagataacccctcacctgaaccccagctggatgacatcaaaagagagctgagggccgaagttgacattattgaacagatgagcagcagcagtgggagcagttcctcagactctgagagctcatcaggaagtgatgatgacagctcgagcagcgggggtgaggacaatggcccagcgtcccctccgctgcccgcacaccagcagccctacaacagcaggccggccgtagccaacggaaccagccggccgcaaggaagcaaccagctcatgaacacactcagaaatgacttgcagttgagtgagtctggcagtgacagtgatgactagagtcggatctttcgaaatcagct

SEQ ID NO: 11191 - DNA, 527 bp, Canis familiaris
gattctgattccacagatgcagccctcacatgtatattttctcaagtacccccaggtaatttggactgtggccaccagactcgctgctttagaaatcatttactgcaactactgattgaggaaactgaggccaaaggcacggaaggggcttgtctcaggttgcccagcacaggagcagctgaccctgggccagaattctcatcttctgaaggaaataaaatgggacttctactacatcccagtaagaagagggtgaagagactggggaagagcaccagaaaggtgccatttcacatctaatcacttcttgtcacgtcgtaaccatcttcctcataccaagccccatactgatagatcagaaataacattttcaaagttatatcttcaaggaaatggctattaatgttcttcttctccttttagagcactgaggaatacatattaattttctctctacttatattgcctatttgcaaattgtattcactacccagtgctccaatttgtcctacccctgaagagattat

SEQ ID NO: 11192 - DNA, 343 bp, Canis familiaris
  misc_feature (151)..(151): n is a, c, g, or t
  misc_feature (153)..(153): n is a, c, g, or t
  misc_feature (157)..(157): n is a, c, g, or t
  misc_feature (199)..(199): n is a, c, g, or t
gctacgatggatgctacccggacaactcgtcatctggaggagactattgacaattttgaaaagcagaaaataaaggatataaagactatattttcagaatttatcactattgaaatgttatttcatggcaaagctttagaggtctacactngntgcntaccaaaacatacaaaagattgacgaagaagaagatttggangctttccgaaattctctgtatccaccagattattcatctcgtctagacattgtaagggcaaattcaaagtcgcctcttcaaagatcactgtcagctaagtgtctatctggaacaggacaggtatccacctgtcaactaagaaag

SEQ ID NO: 11193 - DNA, 236 bp, Canis familiaris
tttctggaggtctaaaagtcttagctcagaaattcccagaaggactgattacgggttccctgccagcatcttgccagcaggcccttcctcctggctctgcccggaaacgatccagccccaaagtgccgcccccaccagctgagaacaagtggagatttactccagaagacttaaaaaagatagaatattacctggaagaggatcagggtcctacggacaatcctagccggctgagc

SEQ ID NO: 11194 - DNA, 491 bp, Canis familiaris
catttcacctttacaaattccacctccctcaggtgatactgaacagcatttgaatggcctaactgtgacgcatcagtctgatgataatgacacaagagtgttagaatctgaatgtcaagtacctgtgcagaaggatataaagataaagaatgcagactcttggaaaagtttaggcaaaccagtcaaaacatcaggtgtactgaaatcctcagatgagctcttcaaccaatttagaaaagcagcaatagaaaaagaagtaaaagctcgaacacaggaactaatacggaaacatatggaacagaatacaaaggaaccaaaaagagttcaagaaaatcagagggaccttggcttcactcaagaatctttttcaaacaaaatgcaaaatcagtaccttggagaacagaaagaccatcagcagtcttcagaagctcaagataaatacaaactctggcttctcaaagaccgtaatttagcaagggagaaagagcaag

SEQ ID NO: 11195 - DNA, 495 bp, Canis familiaris
actgtgacgcatcagtctgatgataatgacacaagagtgttagaatctgaatgtcaagtacctgtgcagaaggatataaagataaagaatgcagactcttggaaaagtttaggcaaaccagtcaaaacatcaggtgtactgaaatcctcagatgagctcttcaaccaatttagaaaagcagcaatagaaaaagaagtaaaagctcgaacacaggaactaatacggaaacatatggaacagaatacaaaggaaccaaaaagagttcaagaaaatcagagggaccttggcttcactcaagaatctttttcaaacaaaatgcaaaatcagtaccttggagaacagaaagaccatcagcagtcttcagaagctcaagataaatacaaactctggcttctcaaagaccgtaatttagcaagggagaaagagcaagagcggaggaggagagaagcaatggctggtaccattgatatgactcttcaaagtgacattatgaca

SEQ ID NO: 11196 - DNA, 498 bp, Canis familiaris
aagtcggtgccaggaccaatgggaaagggagccccggggagcagtcgccaagccccgtgcagttcataaccagtgcaggagctggagattccagtcgctcgaccctgcagagcgtcatcagtggtgttggggaactggatctagacaaagggctagtgaagaaagcagagcccaacaccaaagacaaaccttatcccgactgccccttcctgctactagatgtgcgagacagagattcttaccagcagtgccacattattggagcttacacttatccaattgcaactctgtctagaacaatgaacccttattcaaatgacattcttgaatataaaaatgcccacggcaaggtcatcattctgtatgatgacgacgagaggctggccagccaggcggccaccaccatgtgtgagcggggatttgaaaacctcttcatgctttctggaggccggctgagccaagctaacgcctccggaagagactccaaggctccaggca

SEQ ID NO: 11197 - DNA, 569 bp, Canis familiaris
gttcatcaacagctacaggttctctctcaagtacctttccataagctaaagaaaaagagtaagtctaaaagggaaaagaagaaagaaaagattaatagcagagatgaaaatccaagaaaaaagtttaagcaaatgaaatcaaaggaaaagtccaaaaacaatcagccaaagaagaggaaacaacaggtgtttacttcgaaacctgaagatgaggataatgctaagcctatgaactatgatgagaaaaggcagttgagcttggatataaacaaactccctggagataaacttgggcgagttgttcatataatacaatcaagagagccttcactgagaaattccaaccctgatgagatagagatagactttgaaacactgaaagcatcaacactgagagaactggaaaagtacgttgctgcatgtctaagaaaaagaccgctaaagcttcatgctgagaaaactcagtcatccaaggctgttggaagtggttcccgactcagtgaaagcagcagcagcagcacaagcagctcatcggagaccgagagtagtagcagtgactcgagctcctc

SEQ ID NO: 11198 - DNA, 290 bp, Canis familiaris
tgcagtactttgctgtgaccaacaacaatattgagatgctaccagatgggctgtttcagtgcaaaaagctgcagtgtttacttttggggaaaaatagcctgatgagtttatcccctcacgtgggtgagctgtcgaaccttactcatctggagctcattggtaattacctggaaacacttcctcctgaactggaaggctgtccgtccctaaagcggagctgtctgattgtagaggagaacttgctcaacactcttcctctccctgtgacagaacgtttgcagacgtgctta

SEQ ID NO: 11199 - DNA, 590 bp, Canis familiaris
atatcacaagttccatcagctaaaggttagcaatgaggagtatgcttgcatgaaagcaattaacttcttaaatcaagatatcaggggtctgaccagtgcctcacagctagaacagttgaacaagcgatattggtacatttgccaggatttcactgaatataaatacactcatcagccgaaccgctttcctgacctcatgatgtgcttacctgagattcgctatattgcaggaaagatggtgaatgtacccctggaacagctacccctcctctttaaggtggtactacattcctgcaagacaagcgtgggcaaggaatgaatgacctgttcccagcaaccctcctcgggccaaccacaacgccttgggtgggcaggacaggctccagaagaaagagccagagagaccaagatggaggctgtgaagcaatgtttccaattgcctccatagcaagaagagtttttgtttgtttgtctgtttttttaacctcatttttctatatatttatttcacgacagagttgaatgtatggccttcaacatgatgcacatgcttttgtgtgaatgcagccgatgcatttccttgcagttta

SEQ ID NO: 11200 - DNA, 559 bp, Canis familiaris
agcccaacggcaggcgccatggagtacacaggaagccgatacatcggggaatatgtagacgggaggatggagggcgaagctgaatatatccttcctaccaaaacgaaatatgtcggggagatgaaggatggcatgtttcatggccaaggaaccctgtacttccccagcgggagccgctatgatgccatttgggaaaagggactggttgtgaagggcacatacacattctcagatgggctacagtacgatgcggagcactggcattactgtgacagctatgataggaggttttacaccgagatctgctacggcttgaagcctgcagggatctctcaactcaccaacatggacccacctcgaaagatccctcagggctgttacgactgtggagatggcttctataacccgaccacgagggttgtcaaggactataggaatcgctttctgagaaacacagacgatgacgagcatgagtggatcatcaggacgtgtcgcaagggctgggacgagattgtgggtcaccgaccgaagctgtgagctgtgtggctgcctccactag

SEQ ID NO: 11201 - DNA, 586 bp, Canis familiaris
gcttaccatcagttagctcttcgggtacatccagacaagaacccaaaaaacagggaggcagctgaggagaaattcaaacaagtaacagaagcctacgaggtgttgtctgatgctgagaaacgtaacaactatgacaagtccggagggaaccgcatcaaaacagaaaatacaggcgactgcagagacgaaaagtgcttgaaagaggaaccacggtttgagaggccacactgcggctttcaagatgtctttgaagacaaagacctcttctcaggcagttattttcccactggtcatgtgggtaaggccaggagatttcactcctccttctttgatgtgatccccatattggacacaggattttccacgtttgtttccccaggctccagaccaagtcccccttcctctgggacatttgttcccttcgtaagccgtggaatgggaaacttcagactggtcaccacgtgtagccagatagtgaatggcaagagagttgtgacaaagaaagttctagaaaatgtgacagggaagactggactggaaaaagacagcctatttcatcagatgcctccaggtcatcggaaattga

SEQ ID NO: 11202 - DNA, 510 bp, Canis familiaris
aaacgggcacgactactggagaacaccgaacaacctgaggaaaccagccgatcgaaacagaagagtcgacgtcggtgcttccagtgccaaaccaaactggagctggtgcagcaggaactgggatcatgccgctgcggttatgtgttctgtatgttacatcgcctccccgagcagcatgactgtacgtttgaccacatgggccgaggccgagaggaagccatcatgaaaatggtgaaactggaccggaaagtggggcgctcctgccagcgcatcggggaggggtgctcctgaaggccaggcacggccgccacatgacgctgttcttagttcactaatgttagccttatttaggacaaagtcagccagacaccttgtactgggcacgcgtcagactacagccagtccgtttcctttctttagccagccatcctggtactgtagtttaggggttgatggtggttgaaattgatttctggctggttactaaggtgcctgctagccattgtataa

SEQ ID NO: 11203 - DNA, 384 bp, Canis familiaris
  misc_feature (331)..(331): n is a, c, g, or t
  misc_feature (338)..(338): n is a, c, g, or t
gtggctctaaagtgagtgcaataggataaattcctccactcgggagaaagcagaggcaagaagttgactaaacgatgtttaagaataatgttactgaccataagcctaatgtggaaaccataattaaaaacattaacacaatttctttggagttaaagaagatgaaagagctctcccagttgctgctttgtgaccttactctacattttaatcatcctgtgaagacggatgacttaaaggaaccagaaggaaaaacccgcctctttgaagagtctgcaatatcagatgtgtcccttgcctctaataatttttctatctgatttctttttgnttgttgngaatttataactgtatttattgtggaattaacatgtatctgagaga

SEQ ID NO: 11204 - DNA, 48 bp, Canis familiaris
tacagctgggtggagctcacactgcctttcgccaggaaatatggttgc

SEQ ID NO: 11205 - DNA, 463 bp, Canis familiaris
  misc_feature (176)..(176): n is a, c, g, or t
  misc_feature (191)..(191): n is a, c, g, or t
  misc_feature (215)..(215): n is a, c, g, or t
  misc_feature (255)..(255): n is a, c, g, or t
  misc_feature (282)..(282): n is a, c, g, or t
  misc_feature (419)..(421): n is a, c, g, or t
  misc_feature (423)..(423): n is a, c, g, or t
aaccacatgcagagtctacgctttgagcacaaactctatgctcaggtgaagcagaaaatggaggagatgcaacagcacaacatgtcctggattgaggtgcaattcctgaagaaagcagttgatgtcctctgccagtgtcgtgccacactcatgtacacttatgtcttcgctttctncctcaaaaagaatanccagtccattatctttgagaatanccaagcagatctagagaatgccacagaggtgctttcgggnctacctcgaacgagatatttcccaagnttctctgcaggacataaagcagaaagtacaagataagtacagatactgtgagagtcgacgaagggttttgttacagcatgtgcatgaaggctatgaaaaagatctgtgggagtacattgaggactgagaatggcccnnnanaaaatgaactctgaaaactttaccatctagagtgctcatg

SEQ ID NO: 11206 - DNA, 587 bp, Canis familiaris
gcatgctgcggcacgagataggcactcactacctgcggggcgtgaacaacgcgcggcagccgtggcacagcgcggaaggccgcctgcagtacgggctgcggcccgcgaaccccaccgaggagggcttggccagcctgcacagcgtgctcttccgcaagcagccctttctgtggcgcgccgccctgctgtactacaccatccaccgtgcctcgcgcatgtccttccgccagctcttccaggacctggcgcgctacgtgcaggacgcggacgtgcgctgggagtactgcgtgcgtgccaagcgcggccagacagacacctcgctgcccggctgcttcagcaaggatcaggtgtacctggatggcatcgtgcgcattttgcggcaccgccagaccatcgacttcccgttgctgacctcactgggcaaggtgtcctatgaggatgtagaccatctgcggccccatggggtgctggacaatacccgggtgccccacttcatgcaggacttggcgcgctaccggcagcagctggaacacatcatggccaccaaccggctggatgaagcagaactgggccgcttgctgcctgac

SEQ ID NO: 11207 - DNA, 476 bp, Canis familiaris
ttggcatttgttacgctgtttgtgaatatctgctgagcttaaaggcatttacactgtttgctacgcatttcctggaactatgtcatatagaggccctgtatcctaatgtagaaaacatgcattttgaagttcagcatgtaaaagacacttcaagaaataaagaagcaatcttgtatacctacaaactttgtaagggactcacagaagagaaaaattacggattaaaagctgcagaggtgtcatcactcccaccatcaattgtcttggatgccaaagagatcacagctcaaattaccagacaaattttgcaaaaccaaaggagtacccctgagatggaaagacagagagctgtgtaccatctagctactagacttgttcaaactgctcgaaattctcaattggatccagacagtttacgaatgtatttaagtaatctcaaaaagaagtatgaaacagatttttccagggctgaacaa

SEQ ID NO: 11208 - DNA, 185 bp, Canis familiaris
ctcccgtctgagagccaaagaagcataccgctcgctgtgactgacgctttagagcacattatggaacaactcaatgttttgacacagactgtttcaatcttggagcagcgactgacattgacagaggataagctgaaagactgccttgaaaatcagcaaaggctattcaacgttatccaacagaa

SEQ ID NO: 11209 - DNA, 35 bp, Canis familiaris
agattctgaaggagccaactgtgcgaacgaagaag

SEQ ID NO: 11210 - DNA, 341 bp, Canis familiaris
cttcatgaaagtctggattcaggagaaaaatttagcatcatacttactcttggtcattgcacagaggattgtgctgagaaactatctctaagtctaggagaatatccttttggtgaaaatgaagaacaattaaaatacataaatactaaagagaagaattttgaagagtactggaaaaaagcaaaggaacttctacacagactagaacaccttgaaagagaaagaaatgaggaagaaatacaaagagaaaaagataaggataatgtttcatcagtgaacatagatattcaaaacacattgaaacacctccatgcagatagtcttggcagaggtcctacagc

SEQ ID NO: 11211 - DNA, 211 bp, Canis familiaris
gtcaagacatctcattcaaaaaggtcagaaggagtctgaagatgaaactgagggtgaagaattggatgccagttttaggatatcagtgttcaaactacccatacttacttccgattcactgaagtatgctgcattactgaaaggaaaagagcatgattattttcctacctgtgtccagccgttttctactactcatcaaaaaccagcaatt

SEQ ID NO: 11212 - DNA, 328 bp, Canis familiaris
  misc_feature (140)..(140): n is a, c, g, or t
ggctgaagaccgtttgttaattcaaaacataagtaatgagcgcactcttttgtccaaaggaatgattaaaatggacagattgaggaagaaccaggctgtcttacaacagaaaagtctgattgttcaacaaagagtagaancggaaaaacatcaaaagaatttattgaaacaaatgaaggaaatcagggctcaagaaacatataaaaaacactgtgaagaaaaatttgttactgacatgatcgcctttcaaaaagcttgtgaacaatttcaagatgctaaaacaaaagttgcaattatgaaaaagaatttagtctttcaagttccctga

SEQ ID NO: 11213 - DNA, 322 bp, Canis familiaris
gggcacgccgaggtcaagatcctgagcttgagctgcctaatagcttcgatgataatgttcacggggaccacggtgcaccctctcctgaccctcatcatcaccatggagttgtccgtcttctgcttcttcttcattacctacaccttcgccatcaacagatatatgcctttcatcctgtggccgatttcggaccttctcaatgatctgtttgccttcatttttcttgtgggggccgtgatcatagctgtgaaaagccgacaaaccatgcccatgcactacttcattgctgtgatccttattggtgtggctggactttttgctt

SEQ ID NO: 11214 - DNA, 468 bp, Canis familiaris
  misc_feature (363)..(363): n is a, c, g, or t
tggtcttgctgttcttttctcgggcttctgtctggatgtcagagaagaaaaaagatgaagacagtgggaccagcacatcagtcagtaaagcaagcaaagatacttcctataagcggcaaagcaaagatggtgactgggactctttacaaatgatgaaaaaaacaaagcagaaccaacttactcctgtaactgattcagaagtggctttggtcaatgcctatcttgaacaaagacgagccaggcgccattctcagttcagccaggtgaatcagatccaacatgatagtgatactactgagtgtgacagtgaagaatctaactcaggagcctcctcatggaaggagagtgaaagtgaacaccatntgtcaccagctagtattaagaagagaaaactagctcagaggcaaaggaatgtgggaagttaccaaatcagggaaaggccctgcctccactgcaaagccatgagaa

SEQ ID NO: 11215 - DNA, 321 bp, Canis familiaris
tgcagtctcccatatagtttatccggccaagggcttagagattcatctgggactctggaaccttttagggaacaaagcttagctgcttcttcactttcacccaccgaatgaaggctcggaggggcaatcaccgtgcctaaggccatttggctggttcatgggtgaccgtcctcaggtgatgatgcaggaacccaggctccttccagcttgtggctctgcggtctcctaggcccttgaagatctctgcactgaagagtcacccgctgtcagcggtgcctggaagctgtctgtgcaaagcagaattttgtccctatgtcttcc

SEQ ID NO: 11216 - DNA, 486 bp, Canis familiaris
gcatcaaccttctgaggctactcaataaactgaccaaatggaagcattccagaacaatgatgctggtagtattcaaatctgctccaatcttaaagcgagccctcaaggtcaaacaggccatgctgcaactttatgttctgaagctgctaaaaatacagaccaagtatctggggcgccagtggaggaaaagcaacatgaaaaccatgtcagccatctatcagaaagtacgccaccgcatgaatgatgactgggcttatgggaatgacatcgatgccaggccatgggacttccaagcagaagaatgtaccttgagggccaatattgaggcttttaacagccgccggtatgacaaaccccaggactctgaattttcacctgtggataactgcttgcagagtgtgctggggcagaggttggatctgcctgaggacttccactattcatatgagctgtggctggagagagaggtgttttcacagcccatct

SEQ ID NO: 11217 - DNA, 530 bp, Canis familiaris
attatcgtgcaggtcttcttcagaacaacttggaagaaggtaatgacctgaaatcattctggaagaagctaactctgctagatgcactttatgaaatagcaatggcatggaatttagtaaagccagctaccattagcagagcatggaagaagattctacctaccatagaggaaaaagaaggcttggactttgatgaagaagatatttccatggctactgtgtccaccattttacagcataccaaaggactggaaaatgtgactactgagaacattgaaaagtggcttgaagtggacagtactgagccaggctatgaagtgttaactgacagtgaaatcatcagaagagcacaaggccagacagacgaatctagtgaaaatgaggaggaggaaatagaactgattccagagaaacatattaatcatgcagctgctctccaatggactgaaaatttattggattatctagaacaacaaggtgatatgatcctgcctgataaactggtgattcgtaaacttcgagccaccatc

SEQ ID NO: 11218 - DNA, 482 bp, Canis familiaris
  misc_feature (65)..(65): n is a, c, g, or t
  misc_feature (128)..(128): n is a, c, g, or t
agtgatttctgacctaagccctgttgagactgcaagtgggcacagtctccattcccagttcctangaagcttcctgcaatgactttggctaaagccacagggatccttgcctcagccaggaattactnagcctgattatctccaaggcacctgccagcttggacattctatgaaacgagcaaaattaggaaaaatgtgaagcatgttaagtgaagaaggtttgcacacaaagatggagcaaaaagtcacagaacaatctgcagcagaggtaaactgcaagcaccaagcctcctacaggagtgtgcgatgccagtaaatcgcactgatccaggctgggagcaagatgctgtgtctgaacaccctcgggccagagaagcagaagctctgagttcctgtcaccaccaccccccaccccgccccctgcttttacctgtcaccccaactctctggggatagcagcacctacctcacatattactgtg

SEQ ID NO: 11219 - DNA, 83 bp, Canis familiaris
tcagggcaatgcaagaatttcagaaacccaactccaagctcaggtgcagtccagcaacaacgatgagggcagaccacggccct

SEQ ID NO: 11220 - DNA, 462 bp, Canis familiaris
  misc_feature (297)..(297): n is a, c, g, or t
  misc_feature (357)..(357): n is a, c, g, or t
  misc_feature (429)..(429): n is a, c, g, or t
  misc_feature (436)..(436): n is a, c, g, or t
agtgctgccaggaagagctccgccagctcaaagagaagtcctctgttaccaaagaaaccaatgggaaaaatggcaataagaatatgaacaaaaatgccaatggggttaaaaataaaaaggtgaccataccaagcctcgactgttctgagggcagctatgagaacgaaaagaatctggaggtggtgctgcactacaaggccagccacacggatttaggtgatctaacagaaatggaggaggggaaggaaaaaatcaaggacatgaagcaggtcctctggaatgaagtggtttctgtgnggtcagagcctccagaggtgaagtccacagaagatgaggacggggtttatgaagagtccnaaaaacaggagggcaaggaggaagacagcaaagatgagagcactgatgatgcttgtcccgaagcttcagagnaaagcanccccctcaagctttctgagagcaaaa

SEQ ID NO: 11221 - DNA, 472 bp, Canis familiaris
gaggattctcccattgaagtttgtggagctccaggtctacgaccagcttcagcgcatcctgcggttgaggacagtcactgagaagatctactatctcaggctccaccctgaccatcctgagactgtcttccacttctggatccgactggttcaaattctgcataagggcctgtctatcaccaccaaagaccctaggattcttgtcactcactgtctggtacccaagaacagctgcagcccctcgggagactctaacttagtacagaagaaaccccaagcctcccagcccagtgagagcctcatgcagctgatggccaagggggagagtgaggcactctctcagatttttgccgacttgcaccagcacgatgagttcaggagcagcaaaaagacacagaccaaatgggacagctcagagaaagacactcccagcgaagacagcatcccttgcacgcgtgacctcagttggaga

SEQ ID NO: 11222 - DNA, 584 bp, Canis familiaris
  misc_feature (137)..(137): n is a, c, g, or t
acgcctgattgtgctccagaggtcaccctcagcaggattctccccctgaagtttgtggagctacaaatctgtgaccggctccaacgcatcctgagggttaggaccgtgactgaaaagatctactacctgaggctccntgaaaaacatccagaggctgtgtttcaattctggatccgcttggtgaaaattctgcagaaaggtctgtccatcaccaccaaagacccgagaatccaattcactcactgcctggtgcccaaaatgtccaacagctccacttcaacaacacctgaaagcagcctcccgtcatccactcagcccagcgaaaacttcatgctgttggcagctgagcagaccagtggcagtttctcgaatatctcaggaagaccccagctcacagcagacagtaacaccaatgttgccatcaaaatagacaatttggacagctatcagacacccgcaagagtggtatctccagtcaatttgaacatacccatgagagctgccttgagccacagtctctgggaacaagagaatccagatgaacacttcctgcaggctcctgttgccagttccctaggagagaa

SEQ ID NO: 11223 - DNA, 397 bp, Canis familiaris
gacccagaccagtaatcaattaattaattgtagaaaccatattttggagtttaaggaaaaaatgctacttttaaaaaacaagactgaaagaaatcgccaagagctgatcaaagccttgagtaaaataaagtacgaaatgacacagagaaaaaatacgtcagtaaacttaggaaagctgtttaaatctgaggacttaactgactttgtacgtttttttttaatgttctacaaagataaacccatagatttgctcttgggggacatttttcaggtaaagatgtgtgacccaggagaaactcctgaaaaatgtgcagaacgaaataagcacattcgtattcgatataaaccttctcttttccagcatgtgggtatacagtcatcattccctggaagagaa

SEQ ID NO: 11224 - DNA, 256 bp, Canis familiaris
ggatcataggtggactcctggccagagtttgagcatcctgcttgtgagctcctgtctctcctcatctacttcagtcaccatcagggcagtgattctgtagctcatgctttgttcagctgccacaatagacagaaccactggtcctgtttgtagcacatttaacaatttgtttttagttcagatttctgaaaagtgaaaggtagcttttgttgtaaactttctcaatgtttccagaatggcttttggttttgttgat

SEQ ID NO: 11225 - DNA, 141 bp, Canis familiaris
  misc_feature (39)..(39): n is a, c, g, or t
tcacgtaggatacagaggaattaaaaaaatgcattagancttggctgtgaacttatacaaatgtgaaacattaagatgacagagcagaggaagaaaatggagctcaaatgaaatctacctctcaaagtgaccatgcattgg

SEQ ID NO: 11226 - DNA, 98 bp, Canis familiaris
ggcaggcggagaccgtgcggcagctcctggaagccggcgcggatcccaacggagtcaacagcttcggcaggcgcccgatccaggtcatgatgatgggc

SEQ ID NO: 11227 - DNA, 567 bp, Canis familiaris
aaacagatctcttctatcaccaatcaagagctgaagatgatgcaggatgatctcaattttaaatctactgaaatgcagaaatcacaaagtacggctaggaatttgacttcagatagtcaacgtctacagttggatctacagaaaatggaacttctggaaagtaagatgactgaggaacagcattctctgaaaaacaaaattaagcaaatgacaactgacctggagacatacaatgatttgccagctttaaaatcagcaggtgaagaaaagaaaaagaaattacatcaggagagaacagtattaacaacccgcagaaatgcctttaagaaaataacagagaagctaaacatagaatatgagacattaaaaacacagttgcaagaaaatgagacacattctcagcttacaaatttggagaggaagtggcaacaccatgagcaaaataattttgtgatgaaagaattcatagcaaccaagagtcaagagagtgattaccagtcaattatgaagaatgtgaccaagcagattgcagaatacaataaaagcattgtggacgctctacatagc

SEQ ID NO: 11228 - DNA, 153 bp, Canis familiaris
tgctacctagcccagtctgacacattcttccgcgtgcactggaattgtggcaagatcatcctgcagtctcctaatggacgcttcttaggcattgtggacaatggcctgctgatggccaatgccaccattccaggcgagccaaatgaggaattt

SEQ ID NO: 11229 - DNA, 502 bp, Canis familiaris
  misc_feature (404)..(405): n is a, c, g, or t
  misc_feature (450)..(450): n is a, c, g, or t
  misc_feature (473)..(473): n is a, c, g, or t
tgcccggatggcagcggtagttctagggggagacaccatgggccccgagcgtatcttccccaatcagactgaggaactggggccgcaccagggccctacagaaggcactggggattggagcagcgaggagcctgaggaagagcaggaggacacaggggcaggcccagctggctactcctatcagcccctgaaccaggatcctgagcaagaggaggtggagctggcaccggtgggggatggtgaagatgtagttgctgatattcaggatcggatccaggccctggggcttcatttgccagacccaccagtagagagcgaggatgaagaggaggagggagctaccggactgagcaaccacagctctattcccatggaccctgaacatgtggagctggtgaaaaggnnaatggctggagtaagcctgcctgcaccaggggttcctgcctgggnccgggagatctcagatgcccagngggaagatgtggtacagaaggccctccaa

SEQ ID NO: 11230 - DNA, 499 bp, Canis familiaris
ataatcaacgtcactctagcagccaaaatgtgtagccaagtgctttgccaggatcaaggagtgtgtataaggaaacattggaattcaaatgactatcttcacctgaacccagtgaattttgctattcaacttgagagaagtggaagatacacagtacaagggaaacccacacttgaagacctgcagctattttccaaaaaattttattgcgcttgttatgctaatacacagtgtaaagaaagagtcgacctgactgacattcatactgttaaagtatgcgtgggtgaagatgtttgtatagatgtctatctaaactcagtacccagtggtcacccctctgactggaaggggaaatatgtcacttccagcaatatcttctctgccatgccaccaccggctacagggcctccatgtgttcctggtagagatctcaacaggtgcctcaaagccagatttatagtagaagataactccaaaaccactcaaacgggctatcaga

SEQ ID NO: 11231 - DNA, 497 bp, Canis familiaris
  misc_feature (453)..(453): n is a, c, g, or t
atacaattggtgagagtgccgcattgggggcagcaggagtaatattgtggggaggatttgaatattctgattcaaaggagacctgcttatctgtgcaaaagtccatccaagggccattgggccattatgctgttaatgtgacatctgcagccaaattctgcagtcaaagtctatgtaacaataatggaaggtgtatccgaaaaacacctgaatcctcctcctatctgcatatgcctgaaagtagcactaagaaatacatcctaaataagagtttcagattcatcatttcttcaaccagtaaactgaagacaacaaaggtcatgaagaatggatttgtgtgtcattgctattatggctggcagggagaatcttgtcagcaaccctcttcagatatcttgagagggaagaataaggctccaaggactagctttattgtaccagtttttctcagcntgaccttatctgtgattctatggaatgttatcacctcctcttac

SEQ ID NO: 11232 - DNA, 365 bp, Canis familiaris
  misc_feature (126)..(126): n is a, c, g, or t
  misc_feature (217)..(217): n is a, c, g, or t
  misc_feature (246)..(246): n is a, c, g, or t
  misc_feature (263)..(263): n is a, c, g, or t
gcagtttcttgccttctgtgaagggacagcgctgtgcagatttgatatttcaacttatgatgttttaaaaaattgcacaaaaatatgcctgttggcttttcagtctatatttgaaataacaggttnacaggcagttgtttacttgtggttttgctgcactattgcaatttcaaaggggctttgaagcaattttttataggattcttttgagggtggntatcgaatccatgtcaaggtaatggtatnaggaaatctcatctgcntgttgaatccatagtttgtccagttcagattgatttccaaatctgtcaattagaaattctactttatgtataaaaaggccttttaaaaatgcgggatcttca

SEQ ID NO: 11233 - DNA, 200 bp, Canis familiaris
ggagaaaccaactaagactcaggatattatacccgatcaagggaaagaagttgaaggagcacctgttattcaagggcctgaaatgaaatctgaactacaggaagtggctcagccaatgactggggataaaagcgaagatggtcctgatgtgaaagggctgaaaattccaaacctagagcccattaaaatgccagaagcag

SEQ ID NO: 11234 - DNA, 398 bp, Canis familiaris
ggcaagatggttgcttctcttcaaagcgagatgattgaaagccaagcacaccaagatgtgcaaagtgaacaaaaagtatatacaaaaatacaagccacacataagcaaagagaattggctactaaatcatgggaaaatttcttggccagaacatcaaatgctaaagctttaaagaaagcaaagagacttcaggagaaagctatagaatcctctagatacagtgagcacccaccaaatgcagtatttcacaggacagatattaaaggccttaatacaacggtgccttctggtcgggtagtaacagtggaaagcacccctgcccgattactgggaggacctctggctgatacagatattgctcttaaaaaactccctattcgtggaggagccctacaaaa

SEQ ID NO: 11235 - DNA, 225 bp, Canis familiaris
ttcccttggccagaaatgcactaaaaaggttcaagattcgaagtattcaaccaattaggtcaagacagaaacacaaaaaacactcaccagatttccatgacaaatacggtgacactgtactagccagtgggaccgctttctgtgttgttgcatgggtgtatacagccacacagattgggatagaatggaacctatctccagttggaagagtcaccccacaagagt

SEQ ID NO: 11236 - DNA, 573 bp, Canis familiaris
cgctcccatcacaagaagtactcgaaacccgtgttggtgtattcttggcaccataacagagaagccgatccaaaagattatgatatagagggtcctgaggaaataaaaaagctgtgtaattcaacatactgtcgacttggaactgacgaaccccctgtttggatatcagaaacacacgaacaaatggcacaagtttatttaaacagagaattggctaacataaagaaaaaggctttattgaatgatgaaacaatgagctctgggattattgaaagggacactggattgcctactacaggctttggagctctctttactagacatccaccggatcagtacaaaatgtatgcattgacaacatatgctgaagaatatgctccaccatatgcctatcagccacttgattatccttgtcaagatgattattcaatagtccacagaaaatgccgttctcagttcactgatctagatggttccaaaagatttggcatcaacacttggcatgacgagagtgggatttatgctaatttatatgtaaaacaaaaactctacccgttaactggtggtcctgtg

SEQ ID NO: 11237 - DNA, 527 bp, Canis familiaris
gtcaaatgtgccgtgcaggactacagctataagggtttcataccaggccacccctattttcctgagaaatattggctctgtcaagaggaagtagacaaatgcaacccataccacctgtgtggtgaccggtataacttatggaggatgggaccttacaactgtaccggctggaacaaatataccacatgccttcctcggctacctaaggaggccggaatggagacagcttgtcgaggaatgcctttgcgatgccctcctaagccggaacgactcaatgcctacgagcgcgaggtggtggtgaacatgttgaactcgctgtcacggaaccagccactgccgcaaatcacttcccgatgcgggtgcggggacccgctgcccggtcgcttgcccttccagggttatgaaagcgcttgctctggccgccactactgtctacgtgggatggactactgcgccaccagagcaccctgcacggaacgccgcctccggtctttgtgcacccagcagccgactcagtgtatcgccct

SEQ ID NO: 11238 - DNA, 423 bp, Canis familiaris
  misc_feature (147)..(147): n is a, c, g, or t
acgtctgtggtgaagggccgcttcatgggggacccctcgcatgagtacgaacacactgagctgcagaagatgaaggagggtgaaaaggtctttgaagaagaagtagtggtccagatcaaggaagaaaaccgtttggtgtctgtcatnaaccagattgacaaggctgtggctgtcatccctcgaggagccctttttaagaccccttttggacccatccatgtcaatcggacctttgaaggactgtccttgtctgaagccaagaagcttagttcctacttccactttagggagcctgttgagctgaagaacaagaccttacttgagaaggctgacctggacccctccctggacttcatggactccttggagcatgacatccccaaaggtaatagcctattacttggaggacattggatctgcccc

SEQ ID NO: 11239 - DNA, 480 bp, Canis familiaris
  misc_feature (27)..(27): n is a, c, g, or t
  misc_feature (51)..(51): n is a, c, g, or t
  misc_feature (53)..(53): n is a, c, g, or t
  misc_feature (189)..(189): n is a, c, g, or t
  misc_feature (372)..(372): n is a, c, g, or t
gcctatgggcaagtctagtctctgttncctcatctgtcaaaagtggctgtncncagtgagaggaagatgcgagaagcccagacagcgagccactcagtgcacatacaggagcccagtctgtggcctccctgcgtatacaggcagctcatgagacccagggaggaggaaatgaggtaaccccatcaccgntgttccctcaagaataggtcactgttcaacatgaatcagtaaacttcaagagggtggctcggaggaggaggaggaggctaccatcctgtcaatgcatcatccttctctgatctaagcatcccatcccaggaaaatgaagaaaaacaggaggggacggagtgtgcctgctttccaacactcccngcagggctctgaaccaatacacaacaacaagtgtcagaaaaccaggaaggaaaactgatttttatagaaactggaatgaaactgaccagtctagtttcattatccaag

SEQ ID NO: 11240 - DNA, 172 bp, Canis familiaris
agcctctgccacaaaggtctggcagggccgaacaagggtctcagaaagaggaaagagtgaaggtgaagatggtggcccaggtctcatcccaggggccatgtgctcgcatacagactggtgagaatggcccagacctaagcgaacccttaaaccctgaggttctggcctcagg

SEQ ID NO: 11241 - DNA, 539 bp, Canis familiaris
gggcaattgtcagcgtatttcttttctggaagggtttaaaagcttgggtgcttgtgaatgcctggttcacctatgcaatcttgccagcattttttgtcgtactcatcgtccttgcttgctgtgggaaactccgccgtcaggtgcctgcgaattacattctcctgggattatttacggttcttcaaggtctgctgctcggagccgtatcagttttctataatgccgaggaagtgctgtgggcaacagcagcaactgctctggtgaccttgtcgctcactttatttgctcttcagacaaaatgggatttcaccatgctgaatggaatgctgtttgttttactcttcgtacttattatctatggaattctcttactcttcatacgatcatattggttgcatctgttgtatgctggacttggaactatagtcttctcactttacttggtgatggatgtgcagctcatggtgggagggcgccaccatcactctgacctggaccctgaagagtatgtttttgctgctctgaacatctacttggac

SEQ ID NO: 11242 - DNA, 594 bp, Canis familiaris
tcctgcttcgggtcttcacagagaagcacagcgagtcctgggaactggacgaagccaactatgctgagctactccaagaggagcacttctctgagaatgacgtagatcaggacttcatacatttgtttgagatcgtagcaggaggagagggcaaggagataggcatgtatgagttacagaagctgctcaacaaagtggtcaccaaactcagaaacttcagaacccagggcttcggcctagacgtgtgccgctgtatggtcaacctcatggataaagatggctctggcaagctggggcttcctgagttccagatcctgtggaaaaaaatcaagaaatggacgagccctgcattatttcagccaccacactacacacacagccctaccacacctgtctcccttcaggacatcttccgagagtgtgacgaggaccactcgggcagcttgaactcctatgagatgcgcttggccattgagaaagcaggcatcaagctgagtaacaaggtgacacaggtgctggtggccaggtattcgaatgaggacatgattgtggattttgacagcttcatcagctgtttcctgaggctgaaggcca

SEQ ID NO: 11243 - DNA, 526 bp, Canis familiaris
  misc_feature (407)..(407): n is a, c, g, or t
tgctcatgacagtcctgggtgtgatcttcatgaagggcaactgcgctgctgaggaagacatctggaagttcctgggtatgatgcgagtatatgccgggaggaagcacttcatctacggagagcccaggaagctcatcaccaaagacttggtgaggctgcagtacctagagtaccgccaggtgtctaacagtgatcctccacgctatgagctactgtggggtccgaaagctcaagctgaaaccagcaagatgcaagtcctggaatttttagccaaggttagtgatacagttcccagtgctttctcaacaagatatgaagaagctctgcgagatgaggaagagagagtccaagccaggcgttcggccaggcactactgctacagccagtatgtgttataggggcacaancagcagcttttctcgcctctactgatacctgagggttttttcccaatcatctaaggaaaatatgacatcacaatagggattttcatggatatgtgaaagaatcccatttactgcaacaa

SEQ ID NO: 11244 - DNA, 552 bp, Canis familiaris
  misc_feature (112)..(112): n is a, c, g, or t
tggtggaatccatcagtaatactgtcaagaacttcaaaaaaagtgaagtagagtgtctcataagactttttcacagcttggtggaaagagctaatgtaagacttaataactncggactagatcgtaatgcatttcgagcgatcctgcacagcgtatttggaatgactgatgatatgcttatgaatagggtattttttgcatttgacaaagacaatgataactgcataaatgccaaagagtgggttaaaggattatcggtgtttcttcgagggacttttgaagaaaagcttaagttctgttttgaagtttactatttgaacggtgatggttacatttctcaagaagagatatttgacatgttgaagaacagtctgcaccaacagtcatctgaggaagagactgatgaaggaataagagagttggtagatataacactgaagaaaatggattatgacaatgatggcaagatatcttttgcagactttgagaaagcagtaaaagaagataaacttttgttggaagtgtttggaccatgtttaccagaagcaaagg

SEQ ID NO: 11245 - DNA, 493 bp, Canis familiaris
ggaatacttccagctgaactctcatctctcaacactggcaaatattcataagatctaccacactcttaataagctaaatctaacagaagacgttggccaagacgatcacccaacaggaagcctgcggtcttgcagctcttcagactgctttagtaaagtgatgccgccgaggaaaaagaggagacctgcctccggagatgacttatccgccaagaaaagtagacacgatggcatgtataggaaatatgattcaaccagaataaagacggaagaagaagccttttcaagtaagagatgcttagagtggttctacgaatatgcaggtactgatgatgttgtaggtcctgaaggaatggagaaattttgtgaagacattggtgttgaaccagaaaatgtagttatgcttgtcctagcttggaaactggatgcacaaaacatgggttattttactctacaggaatggttaaaaggaatgacttctctacaatgtgat

SEQ ID NO: 11246 - DNA, 401 bp, Canis familiaris
  misc_feature (29)..(29): n is a, c, g, or t
  misc_feature (41)..(41): n is a, c, g, or t
  misc_feature (43)..(43): n is a, c, g, or t
  misc_feature (49)..(49): n is a, c, g, or t
  misc_feature (51)..(51): n is a, c, g, or t
  misc_feature (60)..(60): n is a, c, g, or t
ggaagagatccaagggctcctcctggacncactggcggccngnctgttngnaggatcccnctgaggcgctgagtaaccgcgtggtgcccttcctgaagcagaagctcctcagcaccaatgatgacattcgcagcaaagctgcctgcatgctcactgtggtcagggaaatatgctgccctggacgcagaagccatccacccgctcctgaacctgctgtgctcatccctgagcaaggcacgcttgaacgccaccaaggccctcaccatgctggccgagacccctgagggccgcaagtttctgagatctcacgtgcccgtcttccgcaccctcgaggaagacactagtgaggcagtgcggcgggcagcccggactgctatcaaagtcatcgagtggaaaccctg

SEQ ID NO: 11247 - DNA, 321 bp, Canis familiaris
agacatttcaagatccgtgtgaggaaatcgttgacaccatctctggcggggtcgaataactttgaggatgccgtcttggattatatcatttgtcatcttgatctatatgattcccaaagcagtgttaacgatgtaatccgagccatgaatgtcaatcccaagatttcatttcctcctgaagttgacttttgtctcctcagtgacttcatccaggagatatgctgcattgcctttgcaatgcagactttagacccacccctagatatcgcatttggggcagatggagaaatttttaatgattgcaagtaccgtcgcagctat

SEQ ID NO: 11248 - DNA, 304 bp, Canis familiaris
agcagcactccatatctctactatggcacttcgtcaggatcctatcagttccccatggtgccggggggagatcggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagcggtatccgggagccatgtcccaaatgtatcaac

SEQ ID NO: 11249 - DNA, 302 bp, Canis familiaris
  misc_feature (50)..(50): n is a, c, g, or t
gggaacgagctctgtaacgtcctatacagacaaagacttagcaagagcgnggcctactctgtgcaggacgagatgctgtgcgccggggacttctcgacagggaaggccatctgccagcagcccatgactagagtagtcccagtgaaggtgtgcagagacccggctctggcaggtgtttgcagacctcgcaccacagacgggacggacccctaccaactccgggctctctccacctttgctcatttcgctgtgcaggcatcgtggtatcttacagcagcctaatttgtgctttcctgtgacta

SEQ ID NO: 11250 - DNA, 123 bp, Canis familiaris
tatggcaggaaggatctggcatgctgctgccgccaccactgctgccacttttcttcccaggtactcaaccagctggaaaccttttgaaaggagtattctgattttctcggtgactcctctctc

SEQ ID NO: 11251 - DNA, 483 bp, Canis familiaris
  misc_feature (73)..(73): n is a, c, g, or t
  misc_feature (98)..(98): n is a, c, g, or t
  misc_feature (150)..(150): n is a, c, g, or t
ctgtccttgctttcaattcctagagaagggaggacgcgcagtgtacggtttcttccaggcccagggcacctgncttcagggctctttactgtagacangcagatctgcttcctagggtcctgcttattgtccccctcccttcccaccttnccatgtttccaagtcagctttcctgcaagaagaaatcctgacaaaaaaaggtcttttgtcaagggtcaagagttgaattgggggtgggggaatggatgcatctgaagcaaagaatgcaggtgcccagatgtgctcccctgagatgtttctctgataacgtccctaatcatgccagagagacgagccatttgccaagaacttggcccaaggcttgagaagactgaaagggccctgccctgcctaacttccttagctcacacctcagctttgctaagagccacctgaggccccagctgaccgcatgcatgtgagccagctcgagaacactaccat

SEQ ID NO: 11252 - DNA, 439 bp, Canis familiaris
  misc_feature (413)..(413): n is a, c, g, or t
aaatggcctttgacctgtatcctttatcatatcctttatcaaactagtgaagatgacctattccagctctctcggtccaagctgcagatgctagcattttttaccacaaatcaagaatggacctaccatgcccgttgtgaacgtgcttgtgggtttttcctttcctgggggttgactggcatgaagatgaagcattgttggtggctgttttgacgtcttccgtctcatcgtcttcctcctcgacgtcctcctcgtcctgagagcttccgaaatataccatgctgttgggcagcgcaggagaacctggtgggttgaagaagacggcttgtgagcacaggcctgggtcctcggcattacacgtagagacatttattaaggtacaaacctaaatcctcatgcctgagcagataaancaaagctgttcatttctactgccact

SEQ ID NO: 11253 - DNA, 470 bp, Canis familiaris
  misc_feature (405)..(405): n is a, c, g, or t
taagggaagtcgtagcagggcacctgctgaaaaaacatcaccccgatggctcaaaggaaatcgtgcttccagatgggacagtgaaacgtctgagtgatggacgtgaagagactgtgtttcctgatgggacagtcgtccacgtggaaaggaatggcgacagaacaatcatgctcagcaatgggcaaagggaaattcaaacggccgggttcgagaggagggagtaccccgatggtactgtcaagattgtgtactgcacgggctaccaggagacccgctatgcatccgggtgcgtgaagatcagatatgagcctggaaacatggtcctggatggaggaagacgcctagaaaataagcagcatgttggcagttagtgggtttttacactcaacgtggagaatcccccantcacagggaaggaaaatcttggaaaatctcatcataagatgtgggtttctgtatgtgttttcaac

SEQ ID NO: 11254 - DNA, 142 bp, Canis familiaris
  misc_feature (114)..(114): n is a, c, g, or t
taatgtgggcatacagaggcggcaccacacccaggagaaaccgggccatggaccagtggacagctctaccagctccacctcttcgcaagctcaagctgtgagggagagagaggntccaccccaggcttaatattcattgaaa

SEQ ID NO: 11255 - DNA, 136 bp, Canis familiaris
gaaatgaagtacatacagcctagccttatcagcagtaccaggggaacaagggatggggaagaacagggcatgaagtggggcctcccctccttctctgacccctcacctgtggcagaaacctatctcagtaaaatgt

SEQ ID NO: 11256 - DNA, 183 bp, Canis familiaris
  misc_feature (121)..(121): n is a, c, g, or t
gcgaccctatggctgttagcaactttgaggatgatgacttctgctagacagcccgccgccagccccaacctgtggtccccgaaatctggctgagaaggccctatcaaatctcggcagcttncaagccctgacctattgtcctccctgaagaaaagaccaatgaagtttggttttgagtctaat

SEQ ID NO: 11257 - DNA, 499 bp, Canis familiaris
  misc_feature (33)..(33): n is a, c, g, or t
  misc_feature (39)..(39): n is a, c, g, or t
  misc_feature (52)..(52): n is a, c, g, or t
  misc_feature (89)..(89): n is a, c, g, or t
  misc_feature (94)..(94): n is a, c, g, or t
  misc_feature (109)..(109): n is a, c, g, or t
  misc_feature (128)..(128): n is a, c, g, or t
atcctcttgcgagatcggtcaacctccccatgnctggcnccaaccttgctgncacctccaccactgctgtcacccaccaccaccatggnctctncggtggccccatcanccccctgtctacactatgncgagggcctttggccccttccctccactacccagcaaatcgatggagaagttggaggttgcaaggtcagaagtgaaattaaactgggctggcctgtcatcgaacccaaagagccacatggttgatctgactcccttggtcctcaaccccggaggcttccatttctcatacctgactggaaacagtgcgcacaagctccattgccctggcttcccctggacctcggcttgtagtggctcccccaataccgaggagacgccacctgctcctgtgaaggcctccatcttcaccccacctgtcttgctcaagttccagcctgtgccaagacccaaagatgactctgagaatgatcctagcagcacagagtctgtg

SEQ ID NO: 11258 - DNA, 494 bp, Canis familiaris
gagctgggattctttatcatcctcctggcccttcctcttgatcaggaggtggcagacatagcttcatgtgtcacatctgcaggaagaaggggacatgtccctttgtttataaagaaaaccagtagccttcccagagccaaccgcagagccgtgtttctgtctcattggctggaagtgtttattgtgaccactcttagctgcaagagaggctgggagacagagcacctctttcctctcctggcagaaagagggagagatacatgtgggtcctgcacacatcacagatgtccactgcagtgcaaacagctggcaggagatggaccagtgtgccatttgttcactcatcactaactgctcatccatgtgccacaattagaccttagaagataaagctgtaggggcatctgacctctgctcaggtcatgatctcgaggtcctcggatggaacctcacctcagtctccccactcagcaggaagtctgtttgtccctctg

SEQ ID NO: 11259 - DNA, 345 bp, Canis familiaris
gagatgactatctccactgctgagacagaagacctgcagagtcccaaatcagaagagcatgaagagtgtgcagagccattgggaagcagcgttttccaagctggtgggacaggccaccctccccgtgtcagaggaacaggagatagccttggaagcaaatacctccagctcatgccagaaaggggacaggttattccagaaagccactttagaaaaagggtaaggaactttctgcaatgtcttaatctcaataaaaaaggcaaaggactggaagatccccttcaaaagggcaagcctgtgtcagcaactgtccagagggaggtaccagtcagaagcagatcagtt

SEQ ID NO: 11260 - DNA, 585 bp, Canis familiaris
ctaaggaaatcagtctctccacctgccagcaacatgctaaagatggaatggaacaaagaagcagcagcaaatgcccaaaagtgggcaaacaagtgcaccttagaacatagcccagcaaaggaccgagaaacccatacaaaatgtggtgagaatctctttatgtcaagttaccctgcttcctggtcagatgcaatccaaaactggtatgaggagcaccatgattttgtctatggtgtaggacctaagagttctgatgcagttattggacattacacccaggttgtttggtactcttcttatcatgttgggtgtggaattgcctattgtcccaatcaagagagtctaaaatactactatgtttgccaatattgtcctgctggcaataatgtgagtaaaaagaataacccttaccaacaaggaacaccttgtgctagttgccctggtaactgtgacaatggactatgcaccaatagttgcgagtatgaagatctgcttagtaactgtgattctttgaagaagacagctggatgtgagcatgaattgcttaaggaaaagtgcaaggctacttgcctatgtgaaaacaaa

SEQ ID NO: 11261 - DNA, 130 bp, Canis familiaris
gaggatgcaaaggttggccaagctaccgtagcatcaggcatacctgctggctgggtggctttggactgtggtcctgagaccaacaagagatatgctcaagttgtggcccaagccaagttaattgtgtgga

SEQ ID NO: 11262 - DNA, 529 bp, Canis familiaris
aaaatgactcttgcacagttgaaggaagctgaagatgaatttgatgaagaggatatgagagctattgaaatatatagagaaaagcggttacaggaatggaaagctcttaggaaaaaacaaaaatttggggaattaagagaaatatctggaaatcagtatgtgaatgaagtcacaaacgcagaaaaagatgtatcagttgtaattcatttatacagatcaagcatcccaatgtgtttgttggttaaccagcatcttagtctcctagcaagaaagtttccggaaactaagtttgttaaagccatcgtgaacagctgtattcaacactaccatgacaattgtctaccaacaatttttgtttataaaaacggtcagatagaaggcaaattcattggaattatagaatgtggagggataaatctcaagctagaagaacttgagtggaaactagcagaagttggagcaatacagactgatttagaagaaaaccccaaaaaaagcattgtagatgtgatggtatcttcaattagaa

SEQ ID NO: 11263 - DNA, 111 bp, Canis familiaris
  misc_feature (51)..(51): n is a, c, g, or t
agtgcagaagcgtggattcgaatcccagctccgtgattgatggctgtgganccacagagagctgtttgcattctcgatgctccactctccacatttggaaaatagaggtat

SEQ ID NO: 11264 - DNA, 426 bp, Canis familiaris
  misc_feature (369)..(369): n is a, c, g, or t
acagagagagtttcggctcctggcatctgtttcatttgctgcttttggaatttgtaactcatatacttcagtcacgcatagaagaagaagaggaggacgacgacgtgggaaatctcaaggaaatgctaccagatgaccagtctcttgtccagccagaccaggcacctttccaccctccagattcttcaccaactcaggagtatgacagcccaagtgtggatccacaccgggtgacactgaaacacatgggccagagccaatatcctgtgggtgtgagcagtgtggttctcagggtcctgggcttcctggtggacactgacacaggcaataagctcatccaggtattactagaagacaaggccacggaangcactgtcaaactcagccttcctgtgggacaagaagcccttgtgaccctaaaagatg

SEQ ID NO: 11265 - DNA, 405 bp, Canis familiaris
  misc_feature (354)..(354): n is a, c, g, or t
ggagcctggtgcctcaggacactaacacaaaagcatcctctcgatccaggaaaacagggtctctgactcgtgcgggcccacgagccttctgttcctgttcctcttgccctggcagctctgcttgctggcgtcgcctgggcctgtgtcacagccgcatctttgatgtcctccttcctcgggcctggccgaccatgccagggagaggatccccaagcctcctcactttctacagaaaacctacaagaaaacactcaagtcatcgtaattcgcgtgctccgagctctcaggactgctgctgtggctctgggggccctaggagctgcgtattacatcattgaatccttgtgaatacanccccccaggcccgtagtccagcagatccagtttccatcaaggatctctctt

SEQ ID NO: 11266 - DNA, 525 bp, Canis familiaris
aataagcagatccttgtgttgggcctggatggagcaggaaagaccagtgttctccactctctagctttaaacagagtccagcacagtgtggcacccacccaaggtttcaacgcagtatgcattaacactgaagatagccaaatggagttcctggagattggtggcagtgaacctttccgttcttattgggaaatgtacctgtccagaggattgctgctgatctttgtggtggattcagcagatcacaacagattgcctgaagctaagaaacaccttcatcaattaattggaacaaacccaatccttcctctggttgtgtttgcaaacaaacaggatcttgaagcagcctatcgtattacagatatccatgaagctttggcattgtctgaggtcggaaatgacaggaagatgttcttgtttggaacccaagtgactgagaatggctcagaaatcccttctgtcatgcaagatgccaaagacttgattgcacacctggctgcagatatgcagtgaccaagcccaggc

SEQ ID NO: 11267 - DNA, 480 bp, Canis familiaris
ctggcactgcccaacagattcaagaaagaatatctaataaatagtgagtacttatcaagagatgctcttcaaagctctgatccttctccccggatattacaactctcaatagccaaagccacaaatccaaactatgttcctccaaaaaggattgaaaccaagatttcagtttctgccctgactgctgttgcaactccaagaattgtagaccttgctcatccaaggatcaagatagagggtctatgctttgaaagagaaagaagtgaactgcccatccgtcctatatcccacgctgccttgctatgcaaacctagccctcgaataatagctctagctaaggccaagcctcttcatcaagattatctacctatccgtgatgcccactggccagtatcttatgctgctatccattgcaaaatatctcctagaattcaagaactagctaatccaaatacaaggtctcctgtgcatattgtatac

SEQ ID NO: 11268 - DNA, 431 bp, Canis familiaris
  misc_feature (40)..(40): n is a, c, g, or t
  misc_feature (59)..(59): n is a, c, g, or t
  misc_feature (89)..(89): n is a, c, g, or t
  misc_feature (134)..(134): n is a, c, g, or t
  misc_feature (172)..(172): n is a, c, g, or t
  misc_feature (180)..(180): n is a, c, g, or t
  misc_feature (205)..(205): n is a, c, g, or t
  misc_feature (371)..(371): n is a, c, g, or t
  misc_feature (392)..(392): n is a, c, g, or t
ccaaccccactctttgtatggaaagagtctcgcagtcctngggcacttagcttcgtggnaggtgtgagccccacagtcctggaccaggnccgaagcctcgggtgctcgcatgtgagaaacattgcggcaaaaanccacccgaaaaccgaaaaccggtcagtgtgattcccgngatacttncctgttcagaggtcaaagaagaaanactgaaagaacactgcttagtgagaaataatccacggtaaaggtatcaaggataaacagcgtcaggacggtggtcatctgtggggcaggatggaggtgagccagaccgggggacgtgaggagactctcactactgcccaggttaggaatcttgatgactccgaggncgattatattagcaaatcctnccgcaaaatattttgtacattctttcctcagtatatttg

SEQ ID NO: 11269 - DNA, 185 bp, Canis familiaris
tactgccgaaaagctaaaaacattagtaaatccagccaatgtaaccttcaaaacctatgaaggcatgatgcacggttcatgtcaacaggaaatgatggatatcaagcatttcattgatagacttttacctccagttgattgatgtcactaagaggccttgtgtagaagtgcacaccagcatcgtt

SEQ ID NO: 11270 - DNA, 340 bp, Canis familiaris
  misc_feature (48)..(48): n is a, c, g, or t
  misc_feature (70)..(70): n is a, c, g, or t
gagctcacgactctacgacttcttcgacccgattgctgatcacatccncagcgtggagatgcagcagggnccgcacgctgctgcactgcgctgctggggtgagccgctcggccgcgctctgcctggcctacctcatgaagtaccacgccttgtcgctgctggacgcccacgcgtgggccaagtcgtgccgccccatcatcagacccaacaacggcttttgggaacaactcatccagtacgagttcaagctgttcagcaagaacaccgtgcacatgatcaactccccagtaggcgtgatccccgacgtctacgagaaagagatccgcttgatgatgccgat

SEQ ID NO: 11271 - DNA, 161 bp, Canis familiaris
ttgatgatgccgatgtgaacagcgcccgacacccgctgaagatcctacaccaacaccgaacccgaacgttaaagttttgttggcaaagaaaactagatgccttttagaagggcgagcaaaaaaagaaaagggggacagttggactttttagcttagtgagt

SEQ ID NO: 11272 - DNA, 495 bp, Canis familiaris
aatggccatccagagtagagacgtggcccagttcagaaatgttgtaacacaattggaagccgatttagacattaccaaacgacaactagggacggaacgctttgaaagagagagggctgtacaagaacttcgccgccagaattactcaagtactgcttatcatatgagttctacaataaagccaaatacaaaatgtcattcaccagaacgtactcaccatcgatctcctgaccgaggcctagatcgatcattagaagagaatctttgctatagagatttctgacacatgaaaagattcttcacatccttgggaaaggtcaaagttacaaactgttttttttttgctatatgattgcatttatcttttgaatgcttgacaatgttaaatgtatttattaactttgtgcctctgaatctctgttctcatgtgccatatcgcagtgatctgagatgacttatagaaacaaaatgcatatggctctttctatccatgca

SEQ ID NO: 11273 - DNA, 197 bp, Canis familiaris
agtatgcaaaaagctgacgcagacagcctcccaagaagaggtgacctcaaagggggactcagaagctcactgttctttcacgagaaccagcccctcacccacacccaacaggcgctagggaaatttcaaaacctaagaatcctttcaactgccacctgcaccctgtctatttggcaatagcgtgtcattgatgataa

SEQ ID NO: 11274 - DNA, 483 bp, Canis familiaris
  misc_feature (32)..(32): n is a, c, g, or t
  misc_feature (91)..(91): n is a, c, g, or t
  misc_feature (106)..(106): n is a, c, g, or t
  misc_feature (185)..(185): n is a, c, g, or t
  misc_feature (233)..(233): n is a, c, g, or t
  misc_feature (360)..(360): n is a, c, g, or t
aagtctcagtggcttttccatgaaatgggggnaatgcccccttccatctgagctcactggaaggaaggaatgagacggtgtctttgggacnttcctggctccctgngtgagggctcaaaggttactgggtcagaagcatccctggtatttcaggacgcagagggccatggtggatgcacaaggangaagcagtctcggtggggaggaatactgaggcaagatcccgggaaacntgaacccagaattggaaccagacatgcagaggaagggtctcttggggccccacacagcagatttccaacaggacggcgagtgtaagccagaggacagatccttggaactcaggatttccaggcatcnggccccactgctggtttatgaccccgacaagaactgaagaaaaccataaaagatgaggaactgatgtttgtatggcctaaacctctgcccactactaagccagccagcccaataaaattcagc

SEQ ID NO: 11275 - DNA, 518 bp, Canis familiaris
  misc_feature (126)..(126): n is a, c, g, or t
  misc_feature (209)..(209): n is a, c, g, or t
ctttttatgggaccacagggctccagctgcttcgttagcaagtgtttatggagcccttccttgctgtcatgatgccttgtgctgtggagaacacaaagatgtctccccccacccccccagaggtgncctgcaggaggaggggagcagggaggaggaggatcagcatagtagtagcagctagtggtggtagcaggattaagcccgtagcncttgtgagaacacatacatcacggccaggaccaggccgccttgcaaacactgcaggagttagcgtgctgaatcctcacgcagttctaggtagttgacatcatatttatcaggcctattttacatacgtgtatactgaatactgaggtcatggctagcaagaaaggccttgattctcttagccactgttcagccaggggaggtaagaccagtacaactcaacaaggtggaaaacaatgccattgaagagatgtgtgctcttggctacagaccttttctctctctgaggtgctcaatctgatggatccaca

SEQ ID NO: 11276 - DNA, 135 bp, Canis familiaris
cctctctcaagaatagtatacatgaggttactccccagtttccaggccagtttagttcccagtatggcaaaaactctaatacccttaaatagtgctgacatccacctccccagagaaggtcctcggcccagggtc

SEQ ID NO: 11277 - DNA, 559 bp, Canis familiaris
gaaactcaccatcatggatgccttatcagtgacagcagtccctcacatccccacctatgttcccattctggacaagcttgttgtttccaaggtttttgacgaggtgttccctctggcacatgtgtccaacgacaccaataagatgacattaattaacccccaaggagtcaagctcaatatctacaagcaaaaagtggaacaggcaattaagagctatgaaagacgtttgaataaaattgtttggagagcattatctcaagaagaaaaagaaaaattagatgcatataagcccatgcggtacttagagaacaaggcagctttaaacagggcattagaacggttgaattggcccatttcattgaaggagctgtcgatgctggaaaatgaaatccttgctgggaaaatgtacatccaacaggctatggaactccaggaggctgccaagaaggagaatcatgcaaacaagtcacaaggagaggtagttcaaggaaatccaacaaagaaaacgaaatcaaaaaaattggatcctctcaaaggtcagaaagttattgcaagatgt

SEQ ID NO: 11278 - DNA, 458 bp, Canis familiaris
tcgatgcctacttccagttgtgtcaggatcccagactgctcccaggagctggggccacagagatggctctggcaaaaatactctcagaaaaaggaagcaggttggaagggcttaatgggcctgccttcctcgcatttgcacaggcccttcagtctcttcccgaaaccttagccgagaatgcaggcctagtggtctcagaggtcatggcagagatgaagggggctcaccaagctgggaacttgctggtaggcgttggggttgaggggatcatcaacgtgacccaggaaggggtgtgggacaccctggtagccaaagcccaaggacttcgagccgtagctgatgtggccctacagctcgtgaatgtagatgaaattatagtggccaagaaaagtcccatgtgtcaacaggactcgaatcctgttcctaagaaggcaaaggaatgcctatctcctgtgaaa

SEQ ID NO: 11279 - DNA, 530 bp, Canis familiaris
  misc_feature (151)..(151): n is a, c, g, or t
  misc_feature (315)..(315): n is a, c, g, or t
tttggtcttactgggtttgatggcagggaaggtggaaaggacacgttgctaatatttttgtccagcaagaaagcaacagaactaaatgccagaagaagacaagctgtttgggctcaaacacacgtgtacacaacacaattcagaaataccnaggaggactcctgcgggcttaatggatggcagtctactgaaacaaaatgtgtatgaagaagaaaatgtcaaacttgagaagcaaattcccttttatttcccaccccaactgcaagaaatggaagatgaaactaccaccagaacaaaagttctttccaaataagnacagtcgtagtactgggttagcggttaactctttcaccctacaaacaaataatctccatcctgtcctgcttgttttctacagcgttggcagcctgagatgacgtttctattatgaggctactaataacgtaaatgggcatcttttaaaacttctcgcagctcaagctagtgaaaccttgtacttctattattgcgccgccattaaaagcagcatt

SEQ ID NO: 11280 - DNA, 324 bp, Canis familiaris
gccagagcagttcgtgcctcagtttccccacccggaaaacgcagtgtagttgagtaggcgcagccgtgggggagaagggggcacgaacctagccggccctgccccgcggagctcgcagctgggagccgagcatcaaagcatccgtgtgtccggctgcacaatacagcagatcgaagatggtcccctgctaacaatctcacacggttcagtctaagatggtagctgtgataggtgctaccatgaagaagatccgcggggactgggcggcagggcgaggtgacaggtggggtcggccgtggtaaccatctgtgtcctgacagcagt

SEQ ID NO: 11281 - DNA, 453 bp, Canis familiaris
  misc_feature (69)..(69): n is a, c, g, or t
  misc_feature (86)..(86): n is a, c, g, or t
  misc_feature (89)..(89): n is a, c, g, or t
ttacacataccctaaaggtgccccagctcagtcctgccgaccggtgctctcagtcaagaagggtggccnctttgaaggctccactnccnccaaggacgactacaagcagtggcctggcatgcgcacagagctagtcaagcccgttccccagttgaacattcccactgagcccttggattgtctgaccactatgcgggcccactatgtgccccacccacccatcaataccaaaagctgtaagccttcctgggtgggcccccgaggaaatatccctgtggagggccagaccacatacaccatcagctttactcccaaggatgtgagcaggtgcctggcttcatacgctgagccccctggctacatctttgaggaaacagacgctttggggcacaggatatacaggccagtttcccagacaggctctcagcaggacagccgtctttctgtagatga

SEQ ID NO: 11282 - DNA, 485 bp, Canis familiaris
tgaaccgcccagctcctgtggaagtcacatacaagaacatgagatttcttattacacacaatccaaccaatgcgaccttaaacaaatttatagaggaacttaagaagtatggagttacaacaatagttagagtatgtgaagcaacttatgacactactcttgtggagaaagaaggcatccatgttctcgattggccttttgatgatggtgcaccaccatccaaccagattgttgatgactggttaagtcttgtaaaaattaagtttcgtgaagaacctggttgttgtattgctgtccattgtgttgcaggccttgggagagctccagtgcttgttgctctagcattaattgaaggtggaatgaaatatgaagatgcagtacagttcataagacaaaagcggcgtggagcttttaacagcaagcaacttttgtatttggagaagtatcgtcctaaaatgcggctgcgcttcaaagactccaatggt

SEQ ID NO: 11283 - DNA, 503 bp, Canis familiaris
aagagatgccactgtgcctcctggatgcttctgatcagcttcctgttagacacggttgttggggcgataaccagacacctcagcctctgctgcaagtcaggagtcgagctgaatgacttcactgtctttaccaccttcggcctggcctcagccctgctcctgggtgtggacgggcccctgaacgggttcctggccatcatctatgtgttagctgctactttccgcctgtgcttttactcaactggtgctcagctcacctataagggcctcccctgccgctatgcttcctgtgtcctggcctccacctcccttctgaccaaaggcaacacgttcattctctcttgcatggcctcgcttatgattctcttcatgatggaccagagctactacccgcatgatgaaatcctggagtctgagaactggaaaaaattggtttatctgggaggtatcttcatgctgcttttgtccccgttctccctaactgctttttactgcttgctgtg

SEQ ID NO: 11284 - DNA, 461 bp, Canis familiaris
  misc_feature (26)..(26): n is a, c, g, or t
  misc_feature (93)..(93): n is a, c, g, or t
  misc_feature (102)..(102): n is a, c, g, or t
  misc_feature (289)..(289): n is a, c, g, or t
  misc_feature (296)..(313): n is a, c, g, or t
  misc_feature (315)..(315): n is a, c, g, or t
  misc_feature (324)..(324): n is a, c, g, or t
  misc_feature (360)..(360): n is a, c, g, or t
  misc_feature (362)..(362): n is a, c, g, or t
  misc_feature (388)..(388): n is a, c, g, or t
  misc_feature (390)..(390): n is a, c, g, or t
  misc_feature (392)..(393): n is a, c, g, or t
  misc_feature (395)..(396): n is a, c, g, or t
tacagtgtactgctataattgtccanctttattgttattaatctcttcctgtgcctaacatacactttatcataggtatgtatgtatagaaancagtacatncaaagtcaggtactatctagttgtaggcattcactggtggatcttggaacttctcctttacaggatgggattgtttccagaagaaagatccacatgaaggctctgcattaacagggagcagcacctccatagacctgagattaggatggccagagcacaaatgagagacagagagagaggcagaccnaggcagnnnnnnnnnnnnnnnnnntncagggaggncgacgtgggactggatccggggtccccaggatcacncnccaggctgcagacggcgccaaaccgntntnncnncggggctgcccacaaatcatctttttttctaaatataattactgcatttcgtatatccacgcaag

SEQ ID NO: 11285 - DNA, 416 bp, Canis familiaris
tgcagggctctggaccgtgtgtcaccatgatctctgctggagccatgtgccaagggcaccctattacctccaattctccagggccttctctctcatctctgccctcatcatcctcattattattatatggctcagcatctctctcaccaaagggccaggacacaaaaactacatagatctgggcatgtccatcttctctttcatctcaggtacctgcctattcctctgcctcattttgttcctgatgcaagtgaaattgtacagtaagaacatcttggagccccatttcctgttagtctaccacctcaattggtggggcagtgtcttctacatgatagctgggttcctctctggactcaatcacataagttctcgggttacccctcctgatcaaaatctccttgtgatccctttaa

SEQ ID NO: 11286 - DNA, 489 bp, Canis familiaris
  misc_feature (42)..(42): n is a, c, g, or t
  misc_feature (80)..(80): n is a, c, g, or t
  misc_feature (87)..(87): n is a, c, g, or t
  misc_feature (90)..(90): n is a, c, g, or t
  misc_feature (96)..(96): n is a, c, g, or t
  misc_feature (102)..(102): n is a, c, g, or t
  misc_feature (130)..(130): n is a, c, g, or t
  misc_feature (237)..(238): n is a, c, g, or t
  misc_feature (297)..(297): n is a, c, g, or t
  misc_feature (333)..(333): n is a, c, g, or t
  misc_feature (402)..(402): n is a, c, g, or t
tctggtcctgccctggttctaaagacctggcgattttctganagggacggggaaccggcgaggtgctgctctgatgggtncggggtncanggcagncggtgncgggttctccaaccccgtgtccaggccnttcccggcccctcctcccatcaccaaggtccttgtgactgtccaggggtgaaggacccgatgcgctttggtccttagcaaaacagaaggaaaatccgacccagggcnnctccgccagaccatgttctgccctttctcagtctccgtagcgtgaaatccacctcttcntgcactcctgcggcctctgtccacattctttgattngaagactcttaagatactctgatttctgatagtccagcattttggagaatgtctgtcatcttccaaatncatctataagtggctactaatcactttctccaccaacgaggattctgaacagttcctggtcagtggctgtcagagtgcttcatttag

SEQ ID NO: 11287 - DNA, 437 bp, Canis familiaris
  misc_feature (97)..(97): n is a, c, g, or t
  misc_feature (168)..(168): n is a, c, g, or t
acatagaacggatgcagcttgctcgagccctaagaaataagcagctcttgccctacatcgagaggtttcggggctcttcatttctacctagaggggncctgtgcccagtggcaaaagacaagaccggggaagacgaggacgatgaggctgatttctatgatgacgccnagcaagaggagagaggcaaggcagagaaaagacaagagatgaacatgaaagtaattttcaagtcagaagagccaaaaaagtgtttcatacaacatccaaataatcggaaaccattcttccccacaaagaaagcagaacggtccatcactggcttaaccaaccggaatcttctccacttggctgaattccctggtgacctaatgctaatgaatcaggattttatatcacggggagtcttccccaccgaggtgacaaaggccagcctcctg

SEQ ID NO: 11288 - DNA, 42 bp, Canis familiaris
gagagcgtccggaaagagtacatgcctaaagctgcctctcac

SEQ ID NO: 11289 - DNA, 404 bp, Canis familiaris
tgagccctctaccagtgatccggaagtcataaagatccaggcctggtggcggggtaccttggtgcgccggacactgctgcatgcagtaatcagagtgatggtcattcagcgctggtggaagcaaatcctgacaaagctgatggagaggaggcggcgtgcagcattggaaacctttacacggaaggagtgggcagcagtcaagctgcagtcctgggtccgcatgtggcgcattcataggcgctattgccgtttgctcaatgctgcccgcattatccaggcttactggaggtgccactcttgtgcttcccggggtttcatcaagggacactacagagtcactgccaaccagctgcatctcgagctagagatcttgatgggctcagggccttgcattgtgtcagagt

SEQ ID NO: 11290 - DNA, 242 bp, Canis familiaris
aaattgaaatcccagcagcaagaggatgtacaaaagcttcgccagaatttgcaccggctccaggttttgtgctgctcagccgaaaaagagctccaatatgagcggggaaagaacttggacttgaagcagcacaatagcttacttcaagaagaaaacattaagatcaaagttgaactaaagcaggcccagcagaagttcttagatagcacaaagatgtgctcttcactcacagcagaatggaa

SEQ ID NO: 11291 - DNA, 572 bp, Canis familiaris
  misc_feature (391)..(391): n is a, c, g, or t
  misc_feature (409)..(409): n is a, c, g, or t
aacactgcttattgctatgagggaaaatgccgagatacagataaacagtgtgcagagttatttggaaaatttgcaaagggttctacttctctgtgcacacaagaagtgaatatgcaggatgatgattttggaaactgtagaggaggattttgtaattttagggatatcttatgtggaaagatagtttgtcactggacacagttagaaataataccatttaaaaaatttgatattcagtatacttacatggaaggccatttgtgtgtctctgcatatttgagaacaccagcagcacatttaagagaagatattacctatacatcaaatggcactatgtgcggtccagatagggtttgcaataatttgcttcattgtcactgtgatgttgganattctcctccactttgtnaaccatcacgaacatcaccaggaggaagtattgataacgggttttggaataggggaagtgatgataacaacctgattataaaaagacgtgcttcttttcgaaaaaatagcctcttgtttggtttctacatttttctacctctccttattatagctgccatcat

SEQ ID NO: 11292 - DNA, 585 bp, Canis familiaris
aatctttactgcatcggaacctgggacttctctctatagccaaggagaactatgaggaagcccgttatcatctggccaatgatatttattttgccagttgtgcatttggaacagaggacatcaggacctcggggggctatttccacctggctaatatcttctacggccttaaaaagttggacctagcagacacattgtacaccaagatcgctgagatctggagtaaatacctgaataatcgctaccaagtgctctcacagaatcgcatccagcagatagacttactgggcaaacgatttgagaccgacactggcttggatgaagcccaggaagcagaagccatacagatactgacctcaatctggaatattcgagaatctacatccaacacagacccccaaaagacaatctttgttctgaaaatcctggtcatgctttactacctgatgatgaattcttcaaaggcaaaatatgccatgagagccttcagtctagccaaagaacagcatctcagtgtcaacgaacaaagcaccattgaagacttactaaatatgatctcagctgaagaagctcatcccattactt

SEQ ID NO: 11293 - DNA, 253 bp, Canis familiaris
  misc_feature (75)..(75): n is a, c, g, or t
  misc_feature (87)..(87): n is a, c, g, or t
tgaagaagtcctagactcaccctcgcgcacacctggcgctgccgggcccctgaggagctcccaacccctctgggnccaggctcaggnccacggggccccctcaagggctaaacgcggccgggatgagggagcagagcagggcccgtggcgccgggagtaaagaagggggccggactgccggacgttcccatagtaaatcttacgaggcgagccagagctggcctcaggatcaagcaataaacgtcaccaacca

SEQ ID NO: 11294 - DNA, 372 bp, Canis familiaris
tgggaaatgtgctgcatggactagcaggatgaattagagataaattgatgggacatggcaagtcaagcatttagccctgtgcctgacaggctgagacttcaattctgcaaactcagatggtacagatggccatgtgctcacatggccagccccttcaggactcaaggatgaaaaactagggaggtgtcatgacatgtcacgtgggctgcattggtgggagtcgagaggacttcagtatttcattccatctacatgatgagcaagtaggacgtgtggaagactctccatatgttttcaggaaacatatgtaagaaaaaagccaagtccttattaacaagctaatttatgatataagcctagccatttgagtaa

SEQ ID NO: 11295 - DNA, 283 bp, Canis familiaris
  misc_feature (251)..(251): n is a, c, g, or t
aggtcccaagaaagagaggaaagcttcaaagaagggcaaggaatcaggtacagaatctgaagatgaaaagaaaggtcccaagaaagagaagaaagctccaaagaagggcaaggagtctgctacagaatctgaagatgaaaagaaaggtcccaagaaagagaggaaagcttcaaagaagggcaaagagtctgctacagaatctgaagatgaaaagaaaggtcccaagaaagagaagaaagcttcaaagaagngcaaggagtctgctacagaatctgaagatgaa

SEQ ID NO: 11296 - DNA, 549 bp, Canis familiaris
  misc_feature (297)..(297): n is a, c, g, or t
taaaaaagggcaaggagtcagctacagaatctgaagatgaaaagaaaggtcccaagaaagagaggaaagcttcaaagaagggcaaggaatcaggtacagaatctgaagatgaaaagaaaggtcccaagaaagagaagaaagctccaaagaagggcaaggagtctgctacagaatctgaagatgaaaagaaaggtcccaagaaagagaggaaagcttcaaagaagggcaaagagtctgctacagaatctgaagatgaaaagaaaggtcccaagaaagagaagaaagcttcaaagaagngcaaggagtctgctacagaatctgaagatgaaaagaaaggtacgaagaaagatgccaagaaagagaagaaaggttcaaagaagagcaaggagtccgctacagaatctgaggatgaaaagaaagatgccaagaaagagaagaaagatattgaaacaaaggatgatgccaagaagggggccaagaagggctctaagaaggatggcaagaaggatggcaagaaagatactgacacagaatctgctgatgcaaaga

SEQ ID NO: 11297 - DNA, 540 bp, Canis familiaris
  misc_feature (78)..(78): n is a, c, g, or t
  misc_feature (512)..(512): n is a, c, g, or t
gaaaggacgccttgtgcaaacccaacgactaaagattatggagtattatgagaagaaggagaagcaaatagagcagcngaagaaaatccagatgtccaccatgaggaatcaggcaaggctgaaagtcctaagagcccgagatgacctcatctcagagttgctgaatgatgcaaagctgagactcagcaggattgtggccgacccagaagtctaccaggggctcctggataaactagtgctccagggtctgctccggctgctggagcccgtggtaattatacgctgcaggccacaggacctcctcctggtggaggctgcagtgctaaaagccatccctgagtacatggcagtctcccataaatgtgtggaagtccaagttgatcaagaggtgcacctgtctatgaatgcagctggaggtgtggaggtctacagtggcaatcagagaataaaggtttccaataccctagaaagtcgactggatctcttagcccaacaaaagatgcctgaaatangaaaggccttgtttggagccaatgccaa

SEQ ID NO: 11298 - DNA, 399 bp, Canis familiaris
  misc_feature (57)..(57): n is a, c, g, or t
  misc_feature (60)..(60): n is a, c, g, or t
  misc_feature (117)..(117): n is a, c, g, or t
ttcaaccctatcttcagccaaaaagagagagagacccaggaaacccaaagcaggagnccncagaagaggggatgcaagactggtgtcatccacagttacagggaagagccacccagnccaggccagaagaccagtggaaggtcctttaaacagactttcccaaagatctcagcataaggaccagagttctcgacacattgctttccctcagcagcttcactctaaggctgcaggtcccccaattcagcaaggggcagggctgagagctggtgacatcctgacccctcaacactgtaagcactgccattgggtccacatggaaaagcatctctcttcccccacacctcgggttccacttaccaggagtctccaaagaatgttagccaagtttctgggtac

SEQ ID NO: 11299 - DNA, 118 bp, Canis familiaris
atggcccctgccaactaaatccagtaagaggaggaaagactggtagtactgacaccccataacccaagacctgaagccaaaccagttgtggggtggaaataataaactagctaaacta

SEQ ID NO: 11300 - DNA, 339 bp, Canis familiaris
tctcggcgagcatcatccattgcggcctcccggctggaggaagccatgtcagagctcactgtacccagctcagttctgaaacaaggccccatgcagctgtggaccacactggaacagatctggctccaggctgctgagctgttcatggagcagcgacacctcaaggaagcaggtttctgcatccaggaggcggcaggcctctttcccacctcgcactcggtactctacatgcggggccggctggccgagatgaagggcagtctggaggaggccaagcagctgtacaaggaggcgctcacagtgaaccccgacggtgtacgcatcatgcacagcctgggt

SEQ ID NO: 11301 - DNA, 444 bp, Canis familiaris
gaaaccaacccggaagacatcatcttttgaaagagaaggatggtggagaatagcattaacaaatactcctatccctggcacttaccacttgaaaactttcattgaagaatccttattaaatccagtaatagcaacctacaattttaaaaacgaaggaaggaaaaaaccacctcttgtgcaaagaaatgatccagtcctaaatgaccttcccctgtacacacctcctgacttcttggacttgttaaagaagcaagtggccacttactcatttaaagacaaacctcggtcgagccccagcaggctggtttacaaagatcagtcagttaagctttcaccagggcaatacgatctacttcctgcaccagttcccaagcacgcttccagaagcttcgtatttcgttctacagttcaaagatttccaacaagctacttcactcctgtaag

SEQ ID NO: 11302 - DNA, 300 bp, Canis familiaris
ccatgggtgaaagttccggcagacttgaaagaccccgaggtgttgcaggtccagacgcagctcttggaagctatgtttggcccagctggatctcgaatcccgtacatcgagcaagtgagcaaagtcatgctcgagctaaaggttctggaatcctcgggcctcaccgaggtcttggtttatggctcttacttgtacaagctcagggccaagtggatgctccagtccatggccgagtggcaccgccagcgacgggaacgagggatgctcaaacttgaggatgccatgaaagccctacagcta

SEQ ID NO: 11303 - DNA, 447 bp, Canis familiaris
ggagaaacgctctcatatccaacgttttctggaaagcatatcttctcaggacaaagtcatagtgtttgtcagccgaaaagccattgctgaccatttatcaagtgacctgattctgcaacatgtatcagtagaatctcttcatggcaatcgagagcagtgtgaccgagagagagcattagaaaactttaaaacaggtaaagtaagaatattgattgccaccgatttggcatcaagaggtctcgacgtcaacgatatcacacatgtctataattacgatttcccccggaacatcgaagaatatgtacacagagtggggcgtactggaagagcagggaggacagggatatctattacgctcatcaccagaaatgactggagagttgctggcgagttaatcaatattctggaaagagcacatcagagcgtcccagaggaacttgtggcaat

SEQ ID NO: 11304 - DNA, 170 bp, Canis familiaris
  misc_feature (39)..(39): n is a, c, g, or t
tcttggtcctcctcagcttgctgtccctaccctcagcanctgcacaagcagccctggcgtgccctggccaaggcccacatggacagcaaaccagctctggcaagaaagatatctcaccaaagatgaaacattttctccacaacttcagagggaccctggcaaaagttatc

SEQ ID NO: 11305 - DNA, 294 bp, Canis familiaris
taggcttccacctattatctcagaagatgggaattattccgtgcaccagaatagccatacaaagtaccatgaagctgtaaagaaggtgctgttaaagacgtttcccaatcaggtcttcagagtccccttaacggatgctcagaacttcagcttctggcggtcccatggtccaggagtgcgtccagaggaaaccatgccatggatccgaagcccccgccactgtctcattaaaagcccaatgaccaggtttatggatcactctgttcttagtgacaggcacttcagtctgtactg

SEQ ID NO: 11306 - DNA, 520 bp, Canis familiaris
  misc_feature (45)..(45): n is a, c, g, or t
  misc_feature (47)..(47): n is a, c, g, or t
  misc_feature (73)..(73): n is a, c, g, or t
gtatctgttgggatatcaaaattcctttcggaacaagaaaagggncncaactgaagaagcaaaccagaagganccagtgtccactaggcttccacctattatctcagaagatgggaattattccgtgcaccagaatagccatacaaagtaccatgaagctgtaaagaaggtgctgttaaagacgtttcccaatcaggtcttcagagtccccttaacggatgctcagaacttcagcttctggcggtcccatggtccaggagtgcgtccagaggaaaccatgccatggatccgaagcccccgccactgtctcattaaaagcccaatgaccaggtttatggatcactctgttcttagtgacaggcacttcagtctgtactgagcaggatgtgtttgcagaagggccaagatggactgtggaagcagggcaaagaaggagaaagtgggagaaggtgtcctggttccactgaaggactaatgggaggaggggatcccaaaagcagagtaaacagattggactaga

SEQ ID NO: 11307 - DNA, 567 bp, Canis familiaris
  misc_feature (376)..(376): n is a, c, g, or t
  misc_feature (480)..(480): n is a, c, g, or t
aaacagtcctcccaatttgcagaagttggttcacatttcagtagaagaattcaaagacagtcaaggtccagttctcacagatccaaatcttggtgtgttgggtttacaaagagatcgttaagcagagaatcaagtaatccctctctgagaggaagccacagaagtgaacgcttcatccaaaatatatgctgtaaccactcaaaagagaaggatgtgcatagttatgaatcaaactgtgggagagcatctttgaccacagtccagtatgtgaaacggccttcaactgctgggaagagacccaagtgttcttctaaaagtgagagtacttcccaacctggaagccactgtaatagcctcacacgcctacagattgagngacatagatccccaagtaaacaagagatgaggcaaaaaactacatttcctagagctggcaaaaccagagcagttaggcgccgaaaaaacaaatgccaatgtctnagtacaaaaactgcaaaggaagtcagtgatgaagtcagggatccgaatgatgtaaggcagaagagtagtctttctgagtgtgcacct

SEQ ID NO: 11308 - DNA, 456 bp, Canis familiaris
  misc_feature (94)..(94): n is a, c, g, or t
ggcacatgtctgatactcagcttcatgttcttaaaaataggatgtttggatgtgattctataaagcaacaaagaaatacagaggagcccagcantctacctgtctcagagaaggattctaattctcagatggatttaagcattcaggtaactgatgatattaatgaaataattcaaatagatggaaccggtgatgcatcttccaatgatgaaataggaagtacaagagatgtagatgagaacgaatttctagggattattgatgcaggagacctaaaggtacttgaagaagaagctgacagtatatcaaatgaagattcaactgccaacagtagtgataatgaagatcctcaaatagacattgtagaagaggaccctttaaattctggagatgatgttagtgagcaggatgtgccagacctgtttgacacagataatgtaatcgtctgccagtatg

SEQ ID NO: 11309 - DNA, 255 bp, Canis familiaris
tttgatctgatcgttacctgtgaagagagagtgtacgatcaagtggtggaagatctgactttgagagagcaggagacctgccagccggtgcatgtgatcaacgttgacatccaagacaaccttgaagaggccactctgggagcgttcctcatctgcgagctatgccagtgcatccagcacaccgacgacatggagaacgatatcgatgaactgctacaggagttcgaggaaaagagcggcagagcctttctgcac

SEQ ID NO: 11310 - DNA, 146 bp, Canis familiaris
tctactgatgagcccggactggcgtggggcgccccgcccacactcaggaagccggcttttccttctcatactcccaacttgcttgtgttcgttttccttttaattgtctgctagtgactactagcacccaataaattagatgtatg

SEQ ID NO: 11311 - DNA, 426 bp, Canis familiaris
  misc_feature (33)..(33): n is a, c, g, or t
  misc_feature (41)..(41): n is a, c, g, or t
  misc_feature (48)..(48): n is a, c, g, or t
  misc_feature (114)..(114): n is a, c, g, or t
aggcctgactcaaggactcctgaaagtcctgcncaagcagngtagccncaagcagtatgtggaattagcagatcttgagcagaaatggaaaaatttgtgcctgccaatagagancttcagggctctgttgcagttggatccttgcgaagacaagatcgagtggataaaatttttagcgcttggatgtagcatgcttggtgggtcactgaacagttcgatgaagcacctgtgcgagatcctcaccaccgaccccgagggcgggcctgcgcgcatcccgtttgagactttctcctatgtttaccgttacttgtccagaatggactcggacatacatgaagtggacacggagtcctaccttgcgactttaaaggacactctagaatctagaaagaatggcatgataggactttcagatttcttcgttct

SEQ ID NO: 11312 - DNA, 117 bp, Canis familiaris
ggaaacctcgagaagaaaattcagaagacagaggccattaatacagaggagaatactttttaatgtcaaatagtgctttttaaaagcttgacaccaaatacagcttgtctttaacca

SEQ ID NO: 11313 - DNA, 79 bp, Canis familiaris
caacgtgtccattggttttgccagtcaaacacagcaagttgcaaaaggcttcttgtggaatagttccaattgcctctcc

SEQ ID NO: 11314 - DNA, 244 bp, Canis familiaris
ctcccaggtgtgagagctggcagtagagcaccctggcagctggtgtcccatcctgttgaccactcctccccacctttcagctcattctcttcagattgtggatgtgagacaagtcttgttgagctgtgtagtgctcttctttgccgtttgcattttacagcattcatttgggagccatagtgcatccactacagagaagatttcagtaataaacagcgaagagggaggtgttcccgattaccag

SEQ ID NO: 11315 - DNA, 301 bp, Canis familiaris
  misc_feature (53)..(53): n is a, c, g, or t
  misc_feature (93)..(93): n is a, c, g, or t
  misc_feature (119)..(119): n is a, c, g, or t
  misc_feature (137)..(137): n is a, c, g, or t
  misc_feature (160)..(160): n is a, c, g, or t
  misc_feature (183)..(183): n is a, c, g, or t
  misc_feature (251)..(251): n is a, c, g, or t
tgcctgacaatctctgttcgtttgaatgaacgtgaaataattgtttacaaganctgtacatacaactgcacgtttgtatacccatctgaagtncctcctgaagccccaagagcaaagtntttcaaaactaatagttnctattttgttcgttgttgtaatnctattaattgcaatgaaggtggncctttaagtctggataatgatatagtccttcagaagccaattgaagagcctttatcgggaattgtgcnctggggggagtacaggttttatctgactgttgcttccatcctagtcagca

SEQ ID NO: 11316 - DNA, 389 bp, Canis familiaris
  misc_feature (208)..(208): n is a, c, g, or t
  misc_feature (262)..(262): n is a, c, g, or t
caaaacgaatccgtgtccgcttggacctatagtttgaaatgccacgattgctgggatatcaacaatttcaactgtcctcaaattaggacgtgtccctatcacatccggcgctgtttgaccatctctatccgtttgaatgttcgggaactcttcgtttacaagaactgtacatacaactgcacgtttgtataccgatctgaagaacctnctgaagccattagaattatgaaaactaatagtttctattttgttcgttgttgtnaatgctatgacttgcaatgaggggggacctaccaatttggagagggatatcatcccggattacccaattgaggaagagttagaaggagccgtgcgcttgggggagtccacatttttcctgagcgttg

SEQ ID NO: 11317 - DNA, 424 bp, Canis familiaris
catgaaaggtgttgcccagggcctacatacattgcacaaggctgacataattcatggatcacttcatcagaacaatgtatttgctttaaatcgtgaacaaggaattgttggagattttgacttcaccaaatctgtgagtcagcgaacttcagtgaacatgatggttggtgacttgagtttgatatcacctgaactgaaaatgggaaagcctgcttctccaagttctgacttgtatgcttatggttgccttttattatggctttctgttcaaaatcagaaatttgagacaaatgaagatggaattccaaaagtggatcagtttcgtttgggtgataatgtcaaatccctcctctatagcttgatatattgtagaagttcaatgactgctgagcaagttttgaatgcagaatgtttcttggtgcca

SEQ ID NO: 11318 - DNA, 477 bp, Canis familiaris
  misc_feature (43)..(43): n is a, c, g, or t
acgcggtgcccatctccgagggcaacgtgctgccgggcctgcngggccgggccgactacgcgggcggcgacctcacccgctacctgctgcggctgctcaacgagtcgggccacgcgttcaccgacgaccacctgcacatcgtggagcacatcaagaagcagtgctgctccgcggcgccggcgcccggccgcgagctcggcctgcgcgtggactacgagctgcccgacggccggcgcctggccgtgggccccgagcgcttccagtgcgcggagatgctcttccggcccagcgtggcgggcagcagccagcccgggctgcccgcgctcgccgccgcctgcctgcagcgctgccgggacgcgggcctcggggcggagatggccgccaacgtgctgctgtgcggcggctgcaccatgctgggcggcttccccgcgcgcttccagagcgagctgggcctgctccggaagacgtcggtgtgga

SEQ ID NO: 11319 - DNA, 218 bp, Canis familiaris
agcatcaccggacggctggactacgcgggctctgacctgacagcctacttgatgggcctgatgaataacttggggaaacacttcaccgaggaccagctaagcattgtggaggacatcaagaagaaatgctgctttgtggccctggaccccatcgaagagaagaaagtcccagccactgtgcacacgatccagtacactctgcctgacgggaaggagat

SEQ ID NO: 11320 - DNA, 459 bp, Canis familiaris
aatttgtgtcacgttctgagatggaagcagatattaaagctggaaaatatttggaacatggggaatatgaaggaaatctctatggaaccaaaattgattctattcttgaagttgtccaaactggacgaacttgcattttggatgtcaacccacaagccctgaaagtgctgaggacatccgaattcatgccctatgttgtatttattgctgctccagaactagagacattacgtgccatgcacaaggcagtggtggatgctggtatcacgactaagcttttgacggactctgacttgaagaaaacagtggacgaaagtgcacggattcaaagagcgtacaaccactattttgatttgatcatcgtaaacgacaatctagacaaagcctttgagaaactacaaactgccatagagaagctgagaatggagccacagtgggtcccaatcagctgggtttact

SEQ ID NO: 11321 - DNA, 277 bp, Canis familiaris
gatccctgtctcattcttgttcattgatagtattactttcaaaaaaatgaattaatcaaggcctcttgaagatgttgaagaattttcaaacctaaggagtgaattgccaaaaataaagttggaagagatacctttcaatactgggcccatccagcattgtagtatgtaggccactcgctgatctatcagtgtatacagttggtcctagtgaagcaaacaggaaccaatacaacatgtcagtggatcctccttgacttctatcccaggcaaatgtgtg

SEQ ID NO: 11322 - DNA, 354 bp, Canis familiaris
aaaacagaagaacctccagtgcacgctaatgaaactgcagaaatgaagaattcccagggggatggtgaacattttgcacacccaccctcagaagttaaagtgcattttgctaatcagtcagtacaacctttggcaagaaagccggaaatgctgtctgaaacttcctccttcccacaaaaaggcctgaagatccctggcctggaacatgcaagcattgaaggaccaatagcaaatttatcaacacttggaacagaagagctccgacaacgagagcgctatctcaagcagaagagagataagttgatgtccatgagaaaggatatgaagactaagcagatacaaaactcggagcag

SEQ ID NO: 11323 - DNA, 79 bp, Canis familiaris
ggagacaattaatgacgtccctgaacttgaagtatggagtaaaatcttgcccttatcaagctccagtttttcaggaaga

SEQ ID NO: 11324 - DNA, 100 bp, Canis familiaris
ggctaaaactagactgatcgaagctgctaacttaaagcttgggtgtgagggtggaacatgacatggagaagaattaccacagatccccactggacatcaa

SEQ ID NO: 11325 - DNA, 529 bp, Canis familiaris
gacagctggcattaaaaccccaacatacaccttactgcaacccgaaccattacattccatatgagcaatttaaatgtgtcataggtgaccagtatactatgtgtcaaaactctgttagccttagtaagcctagtattttagaaagtaaacgagatttgggagcttttgatttagaacattttttaagtaagccagaagaacagtcgtccttgaacacagaaaacgaggaaacaagacctattctgggttggattcctagagctggagtggccaagcctcagactgacctgctggggcttaagaactctttttcaaaaactggtgcacaaaaacgtttccataaatcaattcttgaagaccataaagacctcagggataaagtgcattcagggatgaaacaccaattctatggccataattcctattatttctataattgatattcatcctttccttcaaaacccagcctcttgtaagaaaagtaaaaatataacagaatttcttccatgttgttggattctcttttcta

SEQ ID NO: 11326 - DNA, 400 bp, Canis familiaris
  misc_feature (30)..(30): n is a, c, g, or t
  misc_feature (42)..(42): n is a, c, g, or t
  misc_feature (52)..(52): n is a, c, g, or t
  misc_feature (101)..(101): n is a, c, g, or t
  misc_feature (110)..(110): n is a, c, g, or t
  misc_feature (126)..(126): n is a, c, g, or t
  misc_feature (178)..(178): n is a, c, g, or t
  misc_feature (207)..(207): n is a, c, g, or t
  misc_feature (235)..(235): n is a, c, g, or t
aaggccatctgccagggtgattccgggggncccctcgtctgngagctccccncggcctgggttctcgtggggctgccagctggggctttgactgccgccancccatctancccagcgtcttcaccnagggttggctacttctccgactggatccatgagatccagatgctcacacctnccccctgatcccacatctgctcctcagancccgtttccgggccagcatctgtcgacnggccagctcctctgggcaccctgcagcccttgtgcctccccagacctggctcctgctgctgtgtgcattcagagacccccagtaggccctgcaagtgacccctcccccctagccccagccagctgtctgcctcgggccccagtctggtcaccagaaccttccaca

SEQ ID NO: 11327 - DNA, 328 bp, Canis familiaris
gagcagagtgcagagaccaaaagaagagagttccgaagatgaaaatgaagtgtctaatattttgagaagtggtcgatccaagcaattttataaccagacttacggaggcaggaagtacaaaagtgattggggctcttctggtagaggagggtatcagcatgcgagaggtgaggagtcctggaaagggcagcctggcagaagccgagatgaaggttaccagtaccatcgaaatgtccgaggacgaccctatcgcggggataggaggagatcggggatgggagatggccatcgggggcaaaacacttgacgcttgttgctgtgctatttt

SEQ ID NO: 11328 - DNA, 53 bp, Canis familiaris
ttgctgtgctattttagagcagaaacctctcctgaggtggaatgtttctgaag

SEQ ID NO: 11329 - DNA, 395 bp, Canis familiaris
  misc_feature (66)..(66): n is a, c, g, or t
  misc_feature (153)..(153): n is a, c, g, or t
  misc_feature (227)..(227): n is a, c, g, or t
  misc_feature (304)..(304): n is a, c, g, or t
  misc_feature (313)..(313): n is a, c, g, or t
gtaggttgaggtttccttccactgatggctttgccagtcggagcagaacagtaaaaatcggttcancctccttcctgggttttacacctacaagttctactgtctgaagactgatggactcagccttctcagagtcaccacaacttccagtgncccctgacgtctccaccagactaatgtaatctggttaataaagcagtgagtagcaggaaggtgtgggacaaagnaagccagaaagcattgggaattgtaattttaaaaacgattctaatgtcactcactccgatgacattacaggaggaangggagggtnaacgattttacttccatgacccgagtgagaagtgaccaggtcaagaatagtgccaccggtccatgagtagcacgggcccaaa

SEQ ID NO: 11330 - DNA, 536 bp, Canis familiaris
cccatgtcctactatagtcctgtaaggacagaaggaacaagacctgtacccccttggctgaggtgccatggccagaccctgcctgagtctgctgctcctggtagccactgtgacccttgtgtccagaggtatccatgcctggggcaggtcaaaggtggtgaggacgttccaagacattcctgaaacttatgtctatgtgcagcaggcgctatggtatgccatgaaagagtataacaaggccagcaaagacaagtacatcttcaaggtcataaaggtcttgaaatcccaggagcaggtcacagagagtttagactactttcttgaggtcaaaattgcccgaacaatgtgcaagaaaatttcaggagaaaatgaatattgcctattacaaaaggatccccaaatccaaaagatgtttttttgcacctttattgttgcaaccaaaccttggaaatttgagttcactatgctgaagaaacactgtgaagaggtctaattatcttctagcatattcaactgctctcacttccatttaaaga

SEQ ID NO: 11331 - DNA, 415 bp, Canis familiaris
  misc_feature (65)..(65): n is a, c, g, or t
  misc_feature (68)..(68): n is a, c, g, or t
agatcagggcctgcaggtttccttatcatcttatcaagtgcagaaagaatcatcctgatgtcgcnaancaaattggctacttgtcccttcaatgctcgccaccaggttcctcgggccgaaatcagtcatcatatctcaagctgtgatgataaaagttgtattgagcaggatgttgtcaaccaaaccaggaaccttggacaagagactctggccgagagcacatggcagtgccctccttgcgatgaagactgggataaagatctgtgggaacagaccagcaccccatttgtctggggcacagccaactactgtggcaacaacagccctgcaagcaacgtagtcatggaacataagagtaacctggcttcaggcatgcgtgttcccaagtctctgccgtatgtcctgccatggaaaa

SEQ ID NO: 11332 - DNA, 142 bp, Canis familiaris
aacaatggaaatgcacagtaacggaatatctatctcatcaaatgccagaccctggaagattcttgcttcttcctgctaccagtgggttcttcggggtgtttttcctcctaacctaattatagaaagataaactgtctgtgac

SEQ ID NO: 11333 - DNA, 407 bp, Canis familiaris
  misc_feature (33)..(33): n is a, c, g, or t
  misc_feature (36)..(36): n is a, c, g, or t
  misc_feature (92)..(92): n is a, c, g, or t
  misc_feature (138)..(138): n is a, c, g, or t
  misc_feature (151)..(151): n is a, c, g, or t
  misc_feature (381)..(381): n is a, c, g, or t
tccttatctcactgctgagccagaggtcacttnccnccggttaaggccacaggataaatttctagtgttggctactgatgggttgtgggagnccatgcataggcaggatgtggttaggattgtgggtgagtacctganccggcatgcatcnccaacagccaatagctgttggtggctacaaggtgactctaggacagatgcatggccttttaacggaaaggagagccaagatgtcctcagtattcgaggaccagaatgcagcaacccatctcattcgtcacgcagtgggcaacaacgagttcgggactgttgatcacgagcgcctctccaaaatgcttagtcttcctgaggagcttgcccggatgtacagagacgacattnccatcatcgtggttcagttcaattct

SEQ ID NO: 11334 - DNA, 105 bp, Canis familiaris
tagcgagtggatattattaccctggcatttctcaaaatgaaatagatttcaagggcagacagatttgtaaaagatactaatataataaacatttccagtgggtca

SEQ ID NO: 11335 - DNA, 443 bp, Canis familiaris
  misc_feature (52)..(52): n is a, c, g, or t
  misc_feature (55)..(55): n is a, c, g, or t
  misc_feature (111)..(111): n is a, c, g, or t
  misc_feature (121)..(121): n is a, c, g, or t
  misc_feature (171)..(171): n is a, c, g, or t
  misc_feature (177)..(177): n is a, c, g, or t
  misc_feature (250)..(250): n is a, c, g, or t
  misc_feature (253)..(253): n is a, c, g, or t
tggcctttttatgggtctggtcctggtggtaatatcagaatgtttctatatnccncttccaaggcgtttatctgaacatgctgagcagactcagaggccagaggatgctcncaaagctgancagctgcaggatgcagaggaggaaaaagaggattcaaatgaagaagaaancaaggncagccttgtagatgatgatgaagagaaagaagatcttggtgatgaggaggaagcagaggaggatgaagaaganggncagctctgctcctcctgtgggtgaggggagaaatgacacccagggccaagggcccctgagagaagtccagcaggtgggcgaacttgagcctgaagaacaggtgcctgtgtggcccagctcagtccacgcggaagtagccgaagatacattgaggcagcgcaaaaatcagcatgctgataagggaccatag

SEQ ID NO: 11336 - DNA, 116 bp, Canis familiaris
gggaccataggtctaatgacagtatttcagagaattcagaccaaaggaataggtcagcctccctctggtctgcagtgtaaatcaaatccttattttttcctgaatgagcaagcttc

SEQ ID NO: 11337 - DNA, 445 bp, Canis familiaris
  misc_feature (122)..(122): n is a, c, g, or t
gatgggatggccagacatcaaggacatgccatggatgctgatgtaagccggggccaggcctgagctcttcgaccccagcagctgccctggggaatggctaagtgagccagactggaccctgnagggtgtcagggggcctcgggctcaggggctccagcccaccacgttcacccacacggtccaccccgggctaccagctttctgcagcatgtcggtggacaccactgatggtgaccccagccctgcccatcactgggggctgcgctagctgggctggcatccccacctcagaagccatttcctgaacccacaaattattcttagagaaagatagttatccagaaattccccattaccctcacccacggtgcatgccagcacacacaccccaaacacaggagggccttagggtctggcccgtggcccctaggctgaagggacacag

SEQ ID NO: 11338 - DNA, 536 bp, Canis familiaris
aaaccacagcaatcactttcttcatcctccttctaatttgcttcgtttgcatcttccttttattggtggtttttttatataaatgttcccaaagcaaagttgaagagacagaaaaagttccttgtatagatggtaatggaggtgaaaaatgtgtagctgctgctaatgtggagacaaacaatacaggagaccaagaaaagactctcgtaacacaaatcatagacttgaatgcacccacaaggcctggcattcttgtccagagacggagtaaagacgtggaggacacacctttagaaaacaaagaggagatggaggacaaggaagacaaaatgaaagagaagcaagagcctaagaatgttaaagggaatggcgaagaggatgacgatatccaaaaaccacccatacctctcactaaaactcattcagttgttgaaaaccagaaaagacctttaaaaggagtgacattttctagggaagtaattgttgtggaccttggaaaggaataccccccggcacctcgaagctatactcgagaa

SEQ ID NO: 11339 - DNA, 539 bp, Canis familiaris
tttcttcatcttcatctgtctgggacaacgtcgtagattacctttctctgagctcaatatggaattggctacaagcaactcttctgggagagactagtccacctcagcaaacaaatttgggtctactagataatcttggtccaactgtgcaagttatcctggggatttcctttttgcttttgttgggaataggagtgtatgccatgtggaaacgaagtgttcagtcaattcagaaaatattgttgtttataatcacactctacaaactttacaagaagggctcagatttttttcaggctttgctggtcagcccagatgggaatcttctcccaattcaagacaataatctcttcctgtccttgggtctgcaagagagaattttgaaaaaacttcagacggtggaaaacaaagtgaaggacctggaggggatgatcatttcccacaaacctgccacaaagagggagtgctcctctgagccctactgcagctgctctgactgccagagtcccttacccacatcagggtttacttccacatct

SEQ ID NO: 11340 - DNA, 268 bp, Canis familiaris
agggaagccctcatctctaacttttgcacgtgtcagtgttggaaacacacccatcacagctggctccaagctaccaccagtttacctggttcacaaaaatgcccaaaaacttaacaatctggtcatgacatgagctgccccagcccactgctgcctgcagggaaccctaaccagcagggtttgatatgataaactcgctctgcgactagagatgtggagcaggcagggacggattcaggttttgcaggaccggaagctcatacaattt

SEQ ID NO: 11341 - DNA, 388 bp, Canis familiaris
  misc_feature (44)..(44): n is a, c, g, or t
attgccagcagtgttaattggtcagatgtagacctttcacagtnccaaggtttgatggagagtatgagacaggcagatctcaagaactggtctttggatcaggttcaatttgctgatctctgttcttctcttaatcaattctttacacaaactggccttatccactcacaaagtaatgttcagcaaaatgtttgtcacggtgcaatgcatccaacaaaaccttcccaacacattggaacaggaaatttgtacatagactccaggcaaaatctccctccttcagtgatgccgccccctggctaccctcacatcccacaggcactcagcactccaggaacgacaattgcaggccatcacggagccatgaaccagcagcacatgatgcctt

SEQ ID NO: 11342 - DNA, 406 bp, Canis familiaris
  misc_feature (73)..(73): n is a, c, g, or t
  misc_feature (211)..(211): n is a, c, g, or t
  misc_feature (354)..(354): n is a, c, g, or t
gggccgtgttcaaaccacaggtgtacaagtcagtgttctagtctgtgcagcatcctctccaccggccttcacncgaccttcaagacaagattccgtgatctccgggatgctcaggaacgtgttttgaagatctggggcttcccccaaagcagtcactgagcctcggcctcccctgctcaaccacctacccactccgccttcacgattgcangcgagaggacacagctctctaacgcccgctcagacaggtcggcaggactcacgcggggacaatccaggcaagagcaatcagctttggagattccaaataggacgtgtgtagatcagagagcatttcgtgtttggataacaggnttaaatccttacgggatggttgaaaatcctttgtcaaaggtgaaccgatcat

SEQ ID NO: 11343 - DNA, 372 bp, Canis familiaris
  misc_feature (264)..(264): n is a, c, g, or t
cagtgccagccatcacccagaaaggacacaagggctgggcctcagcacccccaatgtgccaagtggagtttgagatggcctgtgctgctatcaagcagttgaagggacctgtgagtgatcaggagaagctactggtgtacagcttctacaaacaggccacccaaggcgactgcaacatccctgccccacctgctacagatgtgaaagccaaggccaagtgggaggcatggaaccagaataaagggatgtccaagatggatgccnatgaggatctatgttgccaaggtggaagaactgaagaaaaaagatactggttaaggaggacagaatatcaaacacaatgaagtagcatggctcctctggtagcgaaaa

SEQ ID NO: 11344 - DNA, 232 bp, Canis familiaris
ccaagtggagtttgagatggcctgtgctgctatcaagcagttgaagggacctgtgagtgatcaggagaagctactggtgtacagcttctacaaacaggccacccaaggcgactgcaacatccctgccccacctgctacagatgtgaaagccaaggccaagtgggaggcatggaaccagaataaagggatgtccaagatggatgccatgaggatctatgttgccaaggtggaa

SEQ ID NO: 11345 - DNA, 395 bp, Canis familiaris
actttctcctgcaggttggtgcacagtgcgtgtttttagtccttctcatgtaccaacacctgcccctggtgagccaagccgtcatgcgctgcagcaccgagagctgccctggaccctatttctgcctgatccggggtactatggagaagcgaatgtccatctacaccctcattaccttgtccttcatgatcatcctcttctgcttaggtttcttcatgtacagcatccaccattacctgttaaaagggcttgccagtgctaagttttggcttgactaacttttggaagttttcactgagagtctccttccttacactaggaagcttgtgttcctttaaatattgtgtctggggcagggcttcctcctgctaactttctttgctttagaccttcat

SEQ ID NO: 11346 - DNA, 391 bp, Canis familiaris
  misc_feature (44)..(44): n is a, c, g, or t
  misc_feature (48)..(48): n is a, c, g, or t
  misc_feature (77)..(77): n is a, c, g, or t
  misc_feature (110)..(114): n is a, c, g, or t
gagaggtgctgatctccaagcaggtggtggcatccattgagccngganaggggagtttggagggtgactggaaggtncccaagatagaggagaaggaagccctggtgccnnnnnccgaaagccatcgacagcttccacccagaaccccatccccgagtggccttctggataatgaagctgccacggcggaggtcccaccaggacattcaggagggtggccgctggctcagcgagaagcgacaccgcctgcaggccatccgggatgggctccgggaggggagtcacgaggacagccttgaagaggggacccaggggtcctcccactccaagctgccagcccgcaagacccacttcctgtacatcctcaggccctctcagcagctatagggtg

SEQ ID NO: 11347 - DNA, 164 bp, Canis familiaris
aactgcagagagaacacttggctgcagaacaacgcatgatgcatagaatccagaggattatgatggagtgccacagggaaaaggtccaggctgtggagaaggccagggctgaagaaagacagatggcccaagaagcaatccaggcccagaaaagactagccacg

SEQ ID NO: 11348 - DNA, 413 bp, Canis familiaris
gactagccacggaggaaattttgaatactggtataacagctatgaaggatcagaagaagagtatgacccagataataaaagaaaaagaacatgaaatgaacatttactattgcatgactcagagacagaagcaagaagaagttcaggaagtacttcaagaagcagagaagacacatcaggccacgcttggaaatgtgatggataaactggttaacactcagggggagctgctgtccatagcaaaacaactaggcattatgacaaactggaaagatttcctggaggaggaattacaggaaacaagggcagcatttcaaaaatacatcaattatacgtttcctaagctttcgccaggacacgcagattttatactgccagaaagaaagaaaacaccttccagtcttattattcag

SEQ ID NO: 11349 - DNA, 588 bp, Canis familiaris
  misc_feature (36)..(36): n is a, c, g, or t
  misc_feature (39)..(39): n is a, c, g, or t
  misc_feature (44)..(44): n is a, c, g, or t
  misc_feature (57)..(57): n is a, c, g, or t
  misc_feature (63)..(63): n is a, c, g, or t
  misc_feature (70)..(70): n is a, c, g, or t
  misc_feature (73)..(73): n is a, c, g, or t
  misc_feature (77)..(77): n is a, c, g, or t
  misc_feature (79)..(79): n is a, c, g, or t
  misc_feature (84)..(84): n is a, c, g, or t
  misc_feature (88)..(88): n is a, c, g, or t
  misc_feature (118)..(126): n is a, c, g, or t
  misc_feature (128)..(130): n is a, c, g, or t
  misc_feature (133)..(137): n is a, c, g, or t
  misc_feature (139)..(139): n is a, c, g, or t
  misc_feature (141)..(142): n is a, c, g, or t
  misc_feature (145)..(145): n is a, c, g, or t
  misc_feature (147)..(147): n is a, c, g, or t
  misc_feature (152)..(152): n is a, c, g, or t
  misc_feature (154)..(154): n is a, c, g, or t
  misc_feature (174)..(175): n is a, c, g, or t
  misc_feature (183)..(183): n is a, c, g, or t
  misc_feature (269)..(269): n is a, c, g, or t
  misc_feature (451)..(451): n is a, c, g, or t
  misc_feature (458)..(458): n is a, c, g, or t
gggtaccactgtagccggcatgaaccaaacacatgnctnccatngccatggtcaccntggctnccagggntanccangncaccngagncatccaagccatccgagccaccagagccannnnnnnnncnnnagnnnnncnanncancngagcnanccaagccatccgagccaccnnagccaccngagccacagtctgcccaaccgcagccaccagatctgtcaaccctttgaagccacctaaccatgggtggagacaccccttcccccancaaggctggcacacaattgcaggcctgttctctctcctgtggggcagcctgtgtggcccagagtgagatgctgctgcccaaatccctccttcataccccctcaggggtcctgggcccctcccagtctgtgagtagggtatgccacagaggacggctcctgatggagggcgagtggaaggaancgaagcngccaagacagactcacgggcccctgaaggcccacagagaagataggcgaggcagatcccaggagtagctgagagccccagactgacgcctaatgcctggaactgagccaataaagccttgtattccctca

SEQ ID NO: 11350 - DNA, 564 bp, Canis familiaris
acaacagatggtcttctccttccaggaaatccagcaattggaattttgaaatataaagaaaagtattacactttccataccaaagatgctgcatacttatttgcagaaaatcctgaacattatattgatctaattaaagaaaaagcaaaaaaaaatgcagaattaattcagttactggaacttcatcaacagttcgaaaccctcattccatattctcaagtaagcagaatgaaggatgttgacaaacattatataaaaccaattacaaagtgtgaaagtagcactcagacggatacacacatattgccaccaaccattgtgagatcgtatgagtggaatgaatgggaattaagaagaaaagctataaaattggccaatttgcgtcagaaagttactcactcagtacaaaccgatctcagtcacatgagaagagagaattattcacaggtgtacccacccaaggatgctagcacgcagtctatgagagaaggcagcacccgagtgcccaggccccagatttacctagctggtctccgtgggggacagagtaaaatcacttctggg

SEQ ID NO: 11351 - DNA, 352 bp, Canis familiaris
cttcatcaacagttcgaaaccctcattccatattctcaagtaagcagaatgaaggatgttgacaaacattatataaaaccaattacaaagtgtgaaagtagcactcagacggatacacacatattgccaccaaccattgtgagatcgtatgagtggaatgaatgggaattaagaagaaaagctataaaattggccaatttgcgtcagaaagttactcactcagtacaaaccgatctcagtcacatgagaagagagaattattcacaggtgtacccacccaaggatgctagcacgcagtctatgagagaaggcagcacccgagtgcccaggccccagatttacctagctggtc

SEQ ID NO: 11352 - DNA, 540 bp, Canis familiaris
caagagctcttgcagaatccatcccctttaccttctaggtcaggtcacaaaagttgtgctccaaggaagctcaagcgtcctgagcagcctgaaagactgaagtgtacacacaagtttagatgccagattgctgattttgaaaagcttcctgagggataccagaaacacctctcagaacagaagtgttcaaaactcccaacctcccataaaccacccaatcttcacgcagcctccactgcatccactaaaagagagaaaattttggcagacattgcagcagatgaggaacattcaaaagaaacacggtcttttctgtctccaagaaacaagtcaccaggaagaagtgcaagtgcaaagcctgtgccttgtaactgcccccctccaatgcccacagtgtcttccagagggagagaacaagccacaagaaagagtgaaaaggaaaggatgagagaataccaacaagaactagaagaaagagaagaaaaattaaaaaacaggccgctactgtttgaaagagttgctcaggttgtgtttgttgga

SEQ ID NO: 11353 - DNA, 429 bp, Canis familiaris
ctgccatgtgttcatatatctcctgtaaatcgtttcaaatatgtttggaaacttctaaggccagaccaacaacccattatccttgcaaatgattcagcaatcctggaagtacgcagggaagttcaccccttgatttttgagtgtgccaccttggataataatgaaataatagcaacagttaaattcacagtctatacaacaagtgaattgcaaatgaaaagatcagctcgaccagacactgatgcagtcctagtttttgtgctgaccataggagttgttatctgtatattcgtgatctttatactgatcttcttaattataaactggggggcagtcaagtctttctggggggagaaagcctcaacaactgagatacagtctgaactgagttcaatgagatacaaagattcaacttctcttgaccagtca

SEQ ID NO: 11354 - DNA, 423 bp, Canis familiaris
  misc_feature (80)..(80): n is a, c, g, or t
agaatgtccttgtagctgtagagtatgaaccaagaaagtgatccagcatcttgagaagctgagtcaaaaagccaagccanccatctaagctgtgattttcaaggtatggactctagccaactggtaggctacatgcaacttcctgatgttccacaaactgattcccaaatgagggtgatacaggagtggattcaagtttcagatgactattctggctttgattcacagagggcgctggtatgagtattgagaaggctgttttcatgccaccctaagtaaggcgatttacgtatttgagagagaaggagagagagagatagaggaggaagaggctgagagagtcccaagctgactccacactgagcgcagagctggataaagggctcatcgatgaccatgaccccaagatcacgatgccagcag

SEQ ID NO: 11355 - DNA, 211 bp, Canis familiaris
tacagtttgcacaaggtgatcgaaaaacaccaggccaaatgaaatcaaaagaacgtcacccttgttctccaagtgatcataggagatcaagaagccccagccaaaggagaactcgaagtagaagttcttcgtggggaagaaataggagacggtctgatagccttaaagagtctcgacacaggcgattttcttatagccagtctaaatctcg

SEQ ID NO: 11356 - DNA, 170 bp, Canis familiaris
acggctaatggacgatttgaagtaggcaagaagatctgtttgagcatctcaggacatcatcctgaaacttggcagccttcatggagtataagaacagcgttactagccatcattgggtttatgccaacaaaaggagagggagccataggttctctagattacacaccaga

SEQ ID NO: 11357 - DNA, 463 bp, Canis familiaris
  misc_feature (46)..(46): n is a, c, g, or t
atcctggcatggtgagcgcctacatgtacccggcaggggcagccgncgcccaggcagccccccagggccccagcgggcccaccgccagccccgcctactcgtcctaccagcccactcccacgcagggctatcagaacgtggcctcccaggcaccgcagagtcttccggccatctcccagcccccgcagtccagcgccatgggttacatggggagccagtcggtgtccatgggctaccagccttatggcatgcagagtctcatgaccacccttcccagccaggatgcccctctgccgcccccacagcagccctacatcgcagggcagcagcccatgtaccagcagatggcaccctccgggggacccccccaacagccaccccctgtggcccagccgccgcctgcgcagggccctcctgcacagggcagcgaggcccagctcatctcgtttgactgatcctcggc

SEQ ID NO: 11358 - DNA, 163 bp, Canis familiaris
tggctgagcacaagctcccacagctggccaacaaccccatcctgacctgggacagaagggacagaatcaagccatccctcaagacctcatttgtccaaggcccacatgttagggcttgtcccgtcttaggccagagccggtgctcaaggtcacctgttgaaac

SEQ ID NO: 11359 - DNA, 329 bp, Canis familiaris
  misc_feature (275)..(275): n is a, c, g, or t
  misc_feature (278)..(279): n is a, c, g, or t
  misc_feature (281)..(283): n is a, c, g, or t
  misc_feature (286)..(289): n is a, c, g, or t
gaagccatcagttttctggcaacagacaatcatcccaaaatgttaaagtatagatgctcaggttgcatagcagtaggaaaatctctgaatagccgaaattttagcaagctcttgcactcttgcccataccagtgtgatcgtcataaagtcattgtggaagctgaagacagatataaaaatgaactaaggaaatcacttatctgtaacaaaaaaattctgctgaccccacgtagaagacaactcagtagtgaatctgctacttctgaaagaataanaannannnaannnngtggatcttgctcataaataccacaagctgaccaaacacc

SEQ ID NO: 11360 - DNA, 342 bp, Canis familiaris
  misc_feature (145)..(145): n is a, c, g, or t
gatttttcacacattgcaactgttagcattcactgttcttgccattttaattatgaggctgaagttgtttttaacaccccacatgtgtgttatggcttccttgatatgttctcgacggctctttggctggcttttttgcagagtntgctttgagaatgttatctttggcattctagcagtaatgtcaatacaaggttgtacaaacctccataatcaatggagcataataggagaatttaataatttgcctcaggaagaactgatacaatggatcaaatacaataccagaccagatgctgtttttgcaggtgccatgcctacgatggccagtgtcaagctgtc

SEQ ID NO: 11361 - DNA, 409 bp, Canis familiaris
  misc_feature (58)..(58): n is a, c, g, or t
  misc_feature (72)..(72): n is a, c, g, or t
  misc_feature (107)..(107): n is a, c, g, or t
  misc_feature (250)..(250): n is a, c, g, or t
  misc_feature (312)..(312): n is a, c, g, or t
agacagtgatcttcccagtggccaggtaggctcctcaatctgagcaaatctgagctcncatctctcaagaancagcccggaacggtgcaggtccttggatgttctancaaacgcaggaacgtgggatcttggtgttggcagctagggtgcccgtgactattagcacacataattacctaccagctggccgaggtgtcctggtgggaggcagcctggataccagctgggacagagcaaccgagtcaagganttctcaggtctgacgctagtgcagccattgatttatcttcacaatgaccttggccaaatgcnagccagagcacttcttttgtctttattcagctacagtaaagcctcaccatggtgatcaggtttattcaaaaggaacaccatttgatgcggctgcagc

SEQ ID NO: 11362 - DNA, 569 bp, Canis familiaris
gaaaaaatccattatcccagcacctcaaactatctctgtccctatcgatgacttatgccaattccttatcttagctactaacggactctgggaagttttggatacaaaggaagtcactgcactggcaatgacaatgtttcaagtatataaagacacctactattgtatcacacaaaatcaatctttaccatccaaagagcctttcctaatcaatgaactaagcaatactaaatcagaaagtaatatccatatattgtttcagtataaatctgaatctacagaatgtgtgccaactataaatacaaaagaaaatttgtttgattcaaaatattctaaccctaaaaatgcagaaacatttccatcagaaatgactaatcatcatctatacagtgagaaagaaagaaatggaccaaccagtgtagatgtgtcaaaaaattcaagtgaaaaagaatcatgcattaaaaatttctatgaaggtgcagccaagtatattagccatgaacttgtaagtgcggctttagtggctggatccagagacaacattacagtcatggtaatacttctcaagg

SEQ ID NO: 11363 - DNA, 447 bp, Canis familiaris
ttaatattccaaatgccactgctatttataccaaaataaatggacgcctctgtgttgcattggattttccacatgattttattgatggcaataagatgtgggtaaaagaaggaactgtttgtggtcttaataaggtttgcaagaaccaagaatgtgtagatgctgggtacttggattatgattgtactccaagaaaatgcaatgaacggggtatatgcaataataaaaagaactgtcattgtaatccttcatacttgcctcctaattgccaaaatattgatgatgcatggattggtgggagtgttgacagtggcaattttccacctcaacttgcccaactcagttctgaaagacgctacattgagaatgtttaccatggcaaatctacaaaatggccatttttcttactaattccttttctcattattctctctgtactgatcatca

SEQ ID NO: 11364 - DNA, 237 bp, Canis familiaris
ttcaggaagactccttctcttgcgattatccattattaacctttcctcatagccggcaccccccaggtccctgcacattctcttctgttccagacacagaaccaaatacactggtttcttccctcttcctagagggtcagacaggatcggcagggtcatgcttactctctcccagttttatacaaactgcctttggctctcattttcaacttgacctgttcattttgacccatgcaa

SEQ ID NO: 11365 - DNA, 445 bp, Canis familiaris
  misc_feature (29)..(29): n is a, c, g, or t
  misc_feature (92)..(92): n is a, c, g, or t
  misc_feature (231)..(231): n is a, c, g, or t
  misc_feature (347)..(347): n is a, c, g, or t
gaaatttgcagtgtgtgacattcctctcnacgacatctgtgactacaatgtcaccagggaccgctgcaaggagcttgggtgctgcttttacnaaaggcgtgtgctatgagaaagcagtccccatttatgtgcaggtgttctctgccctgatcgtgatcatcgccggggccttcatcatcacaatcatttacagggtctttcaagagcataagagagaaaaggaggtccccncgggtgtccctctgtcatccaagcccagcgagagaggcagggcagccccatccagtgagaagctggcgtccaagacagaggggttggggccgtcgtccaagactacgggcagcagngtggaggacgcgattgtgacaataatgggggagaaagaagagagtgaggactgagggcacgacgaagccaaggtgaagatcggcagagacgtccacct

SEQ ID NO: 11366 - DNA, 497 bp, Canis familiaris
  misc_feature (437)..(437): n is a, c, g, or t
aggaacctggtcactcacatgtgctgggtccctcaagaaccatatatactacagacttctgaagataaaaccatcagattatgggacagccgggggctgcaggtagctcatgtatttcccgcaaagcagcatattcagacctattgcgaggtcagtgaggatggacacaagtgtatctcctgcagcaacggctttggaggggaaggctgtgaagccacgttgtgggacctacggcagacgcggaacagaatatgtgaatataagggccatttccagactgtcgcatcctgtgtctttctaccaagagcactggccttgatgcctgtaattgctacctcgtcacatgactgcaaagtgaagatttggaaccaagatactggagcctgcctgttcaccctgtccctggatggatcaggacctctgacctccctggctgntggcgacaccgtctccttgctgtgtgcaagtttcagcagaggaattcacctactccgagt

SEQ ID NO: 11367 - DNA, 66 bp, Canis familiaris
ttcgaggaattctgtgccgttgtaggcggcctagacatccacaaaaagatggtggtagatgtgtga

SEQ ID NO: 11368 - DNA, 398 bp, Canis familiaris
  misc_feature (193)..(193): n is a, c, g, or t
aaaagtcttccctctaggaggcgtgcgaaaattatttaccatgaacgggcatcttttggacaactccaaggatctgcaagacaaccacttttatgttgctgcaggactggagaccttcaaatatttcccttactggaaatcctcaaaggtgcccagtgaggtccaacaacggtgccgggagggaggtctcctntgggcgcccgaacgaggccggcgcttgcccaggggaaaagaacctcataaatacaacatttcccgtaaggaacaggattctgtgttttatgccaaagaggggaagaagaaaatgctggtagactctttaatcccaaacggcgcagaaggcgacgtgtacaaagcgcagactcctagcacggaaacccagggagcgccggaagtca

SEQ ID NO: 11369 - DNA, 291 bp, Canis familiaris
ggaggacacccagctatggatccagcaggtgtccagcaccccccaccaggatggatgtggtgcacctgcaggagcagctggacctgaagctgcagcagcggcaggccagggagaccggcatctgccccgcagggagctctactcacagtgtttcgatgagctgatccgggagccatcaactgtgccgagaggggactgctgttgctgccgggacgagatccgcatgaccattgctgcctaccagaccttgtatgagagcagcgtggcatttggcatgaggaaggcgctgca

SEQ ID NO: 11370 - DNA, 258 bp, Canis familiaris
gaaggagtccttgacattaacaacgaggcaaatggtgttaaaattggccttcagcacgctgctgctactaatgccatacatgtaggccatcacggaggacagcagggcgggggaggctgctgttgagtccaccctttttactgtctcgctgcccaaattcggcttctcacttcctctcactctcccttgctcagctgagacctgaaactattcgaaatggctttatgtcacaaggctttaatccttcgaattgttgta

SEQ ID NO: 11371 - DNA, 375 bp, Canis familiaris
  misc_feature (46)..(46): n is a, c, g, or t
  misc_feature (114)..(114): n is a, c, g, or t
gtatagaacaatttatcccagaggatccaggaacacaagctccggntactacccaccagccaccagagccagcatttaggagctggatgcagaataggacaagactggaggatntacttcccacacctccaccattctcagattcatcctactctgaacagagaagagactgaagcccttctgatgactccttggaatcccagacctactaggaaccaaggcagcaagtaggaggtaattgtcttctgttgcctccggttcctattctcttctgttagaacagagcattgctgtcctccatatgaacttcccttctgagcctgcttcttaaatcctataatagaattcacccctcctacactaatggttctgttt

SEQ ID NO: 11372 - DNA, 153 bp, Canis familiaris
gaactcagggcggaaatagaactgagaaggcaccccatggcttgttcctgtgttggtttcacccaagtaagaagggccatcacgcgtggaaggctagaaggaagtccacctttgtgcaggaacatgttactacagtgatttctatgcaacatt

SEQ ID NO: 11373 - DNA, 506 bp, Canis familiaris
  misc_feature (67)..(67): n is a, c, g, or t
  misc_feature (80)..(80): n is a, c, g, or t
agaaaacccctacaggtgaagactggtagaaggagacattttctgaagcgcccgtggaggaggagcnctggttagtgtcncaaggacgagctcagtctttgccaaagatgaagtagtctttgcttctgcttcgcttcccgcaaaactcttcataacatgggctgcatgaaatcaaagcaaactttcccatttcccaccacatttgagagcgagaagcaacatgcaagtgaagaaagcttcatgtccgaagagagattcctacccaggatgccttccccagataccgtcagaaaggaagcgaaggaaccaccagcgcctaaaattgtgattttcgaatttgcacaccgcctatcccaggagatcttgagtgacgccttgaagcagtgggcaggcgagaacatcaagtactatgacatcccatacattgagagtgaagggccatgacatcgtaggaggaggagaactttcttgaattgtgggtaaagctggtgctagtttaaatacgt

SEQ ID NO: 11374 - DNA, 369 bp, Canis familiaris
aacaaggtcattcttggcaccggtcaagccagttactttcgtgagtccaagttccagaagcaaatacattcctctgtatactggttacgtgcagtccacaagtgccgatgacgtcgacaacccctttggagacatcacgtccattgccaagcctcggagctctaaaattctctatacaaacacaagtcgctctgccgacattccggggtacaccagcaagcggcgctccgtagccagccgccctgcacatcctgaaatcctgccgacaaccccgtcgacggactccgaagcccaccgcatcttacggaaagaaatggaagttgacctcttcggtcaccaggcaccgctgtctcgaatggtcacaactgt

SEQ ID NO: 11375 - DNA, 497 bp, Canis familiaris
ctccagtagcaaaaacgcccagtgtgatagaagccttgaaccagcagagcaagcctgcccagcctgggatctcactgagcaaagccccacccccgcccctgccgccccagccgcccagccgcctcccccagaagaggcctgctcccgggtgtcacctaactaattcaccaggttcaagtgtcttaaaaataacttcacaagaatatttaaactatctctctggaacggaagttctgggtcctctgtccaacactggagtcctgcagcccccagcccccatgcccaggaagtcacagacaaccaagttaaagcccaagcgggtcaaagctctctataactgtgtggctgacaacccagacgagctgacattctctgagggggatgtgattatcgtggatggagaggaggaccaagagtggtggattggccacatcgatggagatcccagtcgcaaaggagcatttcccgtatcatttgtgcactttattgctgactga

SEQ ID NO: 11376 - DNA, 439 bp, Canis familiaris
ggaactgaagttcctggactcatcaggatgttcaacaacaaaggcaaagaagtgaagaaggtggaattcaagcacggtggacactatgtcactgcccccaaagaaggttcttttgagctttgtggagaccgagtcctgaaactgggaaccaatatgtacagcattaaccggcccgtggaaacgcatatgtctggagcatcaaaaaacttggcttcacgtacacaggaaagcattgttccaaaccctcttgctaaagaagagctgaatctcttggccaggctgatgggagggatggagattaagaaagccagtggccccgagccaggattccggttgaatctcttcaccaccgatgaagaggaggaacaagcggcgctcaccaggccagaggagctatcgtacgaggtgatcaacatacaggctactcaggaccagcaaa

SEQ ID NO: 11377 - DNA, 116 bp, Canis familiaris
tgtgagtctgcccatcattttccatgtgccatttcttatcccttgtgggcaatggcagagaatgtggtcaggctaaagttcagtccatttatatggcatgtacaaattttcaataa

SEQ ID NO: 11378 - DNA, 418 bp, Canis familiaris
tacactacgtgccagccaccaaggtgttcctgagcttccgccggcccttctggcacgacgagcacatcgagggcggccactcgagcaccgcccgcccgtcgcgcgtgatattctacccgccgccgggcgagggcgcgcttctgctagcctcgtacacgtggtccgacggggcggccacattcgccggcctgagcgcggaagacgcgatgcgcgtggcgctcgacgacgtggcggcgctgcacgggccgatcgtgtaccggctctgggacggcagcggcatcgtcaaacgctggggcgaggacccgcacagccaggggggcttcgtggtacagccgccattgctgtggcacgaagacagggaagacgggaaggactacaactgggcggtcccttacggccgcatctacttcgcgggtga

SEQ ID NO: 11379 - DNA, 552 bp, Canis familiaris
tcagaaaagactctccggacgcttctgaggccaagtgataaagtttctaattactataagacaacttcttctgagatcagtgcggttgtaggagctattccttctacttgttatcccatctatggtgttccaaccattcggtctgatattcctgccccccgaattcgtcgcatcagtgatagaactaattatggtgaagagggcaatgcctattcactactacatcctactgtctttggccagaaaggagtgtttgaaagagacttcttcaagaccagatcaaaaaaagagattgcagagatattatgtaacattggtgttaagctttctgatgaagaatttgaaaatgtatggaatcttgcatcaaaaaaacaccacagaggagaagtttgtgttgaaaccatcagaaatgttctggatgagctacaacatgcagacagaatcaagtgtaaaacaagcatgtgatattttggagttcattcatttaaacaaaagaattactaaatatgtgttcatgaaaaatgtttagtccattctggttttagatcttat

SEQ ID NO: 11380 - DNA, 188 bp, Canis familiaris
aacagccgagaggagcacacgtggagcgacagcaacagcgaagaggggcttgtccatctggtgcccaaccatccccgtctggtgccccaccatccccgctgcgagttccagaagggtggtgccacccacagcccgggcgaacataggattactgttcggcacagcacccacaagagagccgagcatta

SEQ ID NO: 11381 - DNA, 344 bp, Canis familiaris
gtcggcgacaatgtttttgcagctgtgctgtcaagccccatctcttccgttctggccatttctggcttccctttgaggagtgatgtgtttgagcttctcgctttaacgttgtcatgtgtaggtcactgaacggagcacctgccacttccgggaaatgctgacctggtgacaattagaaacttaaataaagagcccaagtgcaaaagaggtgtgatccgatccgatgtggatggggaaagaaatccctggaatatgactcttgatcgtttaatcatcttctaaaggaccgtttacatcacaatatggaagtgaaacagcagaaggctcacttcagtttcattaca

SEQ ID NO: 11382 - DNA, 344 bp, Canis familiaris; identical to SEQ ID NO: 11381

SEQ ID NO: 11383 - DNA, 163 bp, Canis familiaris
tgaggcctccaaggagcactggtcacggaaactcggccaaagaaaacttcctgccttccacttgtctcctggtcttcagccaccagtgtgtgcctgctgaggagcagaattaccaccttcctaaacgcggggaagtaataaaggcatgaaaaggctagggcca

SEQ ID NO: 11384 - DNA, 416 bp, Canis familiaris
  misc_feature (56)..(56): n is a, c, g, or t
  misc_feature (97)..(97): n is a, c, g, or t
  misc_feature (99)..(99): n is a, c, g, or t
  misc_feature (102)..(102): n is a, c, g, or t
  misc_feature (115)..(115): n is a, c, g, or t
  misc_feature (143)..(143): n is a, c, g, or t
ttggagtatctcaagagctcagtggagaatctgtttaaaaagattaattgtgatgnccccgagatcctggggcatttgggggagacagggaaaatcncntgncaacaacctcccncagtactttgccatcgttgagaagaagnccaacgatctgctgctgttggagtcctacaagcggatcttggagctggaaggggcagagacagacatgccgcccttcgtcaaccctttctggggtagctccgccctcctcaagcctgcagaacaggtcaaggtcatccccccagtgctcggggctgaccccttcagcgacaagttggatgaagatcagcctctggaccacagcagccttcagcagctggtgctcagcaaccagttacgaagcagggaattacactcagacagcataccagaaa

SEQ ID NO: 11385 - DNA, 70 bp, Canis familiaris
aagaagttaacggtctgaggcggatggagctacatttgtactttaaccagaataaatgttttgttctgta

SEQ ID NO: 11386 - DNA, 418 bp, Canis familiaris
  misc_feature (27)..(27): n is a, c, g, or t
  misc_feature (196)..(196): n is a, c, g, or t
ggccgatggataagtgctatcccgtgncccctcagagacgcagagtcaagagcaggaagaagccagtctctgaggctgtgccccccaaggcgaagggaggactgaatggtgctgcccctgagggggagactgacatcttgtctcagcgtgagggggaagcagccggccctgggcccgctgggaaggaggtggctgnggaggaagaggtggcaggggtcccaggctgggaggaaaacacccaggtccgcaaggagattgcagtatacgcctctgaggcctctgagatggagagtaaggagggaaggcctgggggctgggtcccccagctcctgaggaagctctggttggactggttcccagcccctgacatcccgaagactcagaaccacgaatgaccaagcacccaataaatgcacag

SEQ ID NO: 11387 - DNA, 354 bp, Canis familiaris
tgcgggaggccatggccctaactatcgcccagaccaacaatgagctcgaagcccagagggtggccacagaattcaccttcaggaagcggctgcgggagatggagagagtgtacggcgagctcaggtggcaggagaagaacaccttggaggagatctccgagctgcaggaggacatccggcacctggaggacgatctgcgcagaaagttccagaacctgaagctatgccacacccggctagagtcccggactcgccggcccaacgtggaactgtgccaggaccaggctcagcacggcctcactgacgaggttcaccagttagaggcaaccatcgctgcgctcaagcacaagctgg

SEQ ID NO: 11388 - DNA, 446 bp, Canis familiaris
  misc_feature (50)..(50): n is a, c, g, or t
  misc_feature (64)..(64): n is a, c, g, or t
  misc_feature (69)..(69): n is a, c, g, or t
  misc_feature (96)..(96): n is a, c, g, or t
gagcctgagaaggagctatcccggaagccagaggaggtcctgagagagtncaagctgccagacngggancgtcatctgtgtcggggagcagctgtnccaggcgcctgaggccctgttcgcacccgaccagttgggcatccagaacccaggcctctcgaaaatggtctcctgcagcatcagcaagtgtgatgcagacatccagaagaccctttttggggagattgtgctgtccgggggcaccactctgttccagggcctcgatgaccgtctcctgaaggagctggagcagctggcttccaaggggacccccatcaagatcactgctccccccgacaggtggttctccacttggattggggcttccattgtcacctctctgagcagcttcaagcagatgtgggtcacctccgcagatttcaaggagtttgggacatccgtggttcaga

SEQ ID NO: 11389 - DNA, 84 bp, Canis familiaris
ggtgcttctgaagggctctgggcaaggggtaggagtgggcagtgagcttgccccttggcatcagcaggatgttcaataaaagac

SEQ ID NO: 11390 - DNA, 577 bp, Canis familiaris
gtgatccgttttaaaccatctctctttcagcacatgggttattactcatcatataaagggactgagaataagctgaaggatgatgattttgaagaagagtcatttgacatccctgataaccctcctgcaaatctatataccaacatgaatgtttttgaaaattatgaagcaagcaaggcgtatagtagtgttgatgagtacttttgggggaaaccaccttcaacaggagatgtctttgtgattatatttgaaaatccaattttaattaaaaaaattaaagtgagtactggaacagaagatcgacaaaatgacattttacatcatggagccctagatgttggggataatgttgtagatctcaaacaaagtagacaatgtgttacttacttaagactaggggaattcaaaaatggaaattttgaaatgtcagaggtgaatcaaaaaattccatttgatatacattgtataaggatatatgttaccaaaacacaaaaggaatggctgattattaggagtattagcatttggacttcttagccaattaaatcaatatgtccagttactgaagcaggctttc

SEQ ID NO: 11391 - DNA, 575 bp, Canis familiaris
  misc_feature (490)..(490): n is a, c, g, or t
  misc_feature (507)..(507): n is a, c, g, or t
ggagttcgcgtcacagtcctcgttgacgtggggagaaggcacatcatctggatgaatcactatttcgtgtcttttgcgatcgtcacaacggctaccctagcgtacttcatcttctaccacatctggagactctgggtagcccggattcagagccggaggcggcagcggctaaccacccacctcaagcaggccttcgggcagctgcagctccgggtcctcaaggagggggacgccgagctgggcgccagcggggacagctgcgtggtttgcttcgagctctacaagcctgacgacacggttcgtattctcacgtgtaagcaccttttccacaaggactgcatcgacccctggatcctggcccacgggacgtgtcctatgtgcaaatgtgacatcctcaaggctctgggcgttcaggtggacgtggaagacggagcggagtcgttgcaggttctcatgtcgagcgagctgtctgccgccctgtcccctggcncggaggggaccgccgcngacctccctgccccgggcgggtcggacaaaggggcccctccccagaacgacagccagcctcgttcggg

SEQ ID NO: 11392 - DNA, 407 bp, Canis familiaris
ttcgtgtcttttgcgatcgtcacaacggctaccctagcgtacttcatcttctaccacatctggagactctgggtagcccggattcagagccggaggcggcagcggctaaccacccacctcaagcaggccttcgggcagctgcagctccgggtcctcaaggagggggacgccgagctgggcgccagcggggacagctgcgtggtttgcttcgagctctacaagcctgacgacacggttcgtattctcacgtgtaagcaccttttccacaaggactgcatcgacccctggatcctggcccacgggacgtgtcctatgtgcaaatgtgacatcctcaaggctctgggcgttcaggtggacgtggaagacggagcggagtcgttgcaggttctcatgtcgagcgagctgtc

SEQ ID NO: 11393 - DNA, 183 bp, Canis familiaris
tcatctataactacccaggtacgggcaacaaagtgtttcccatgtctcaccagggaacggaaaatatagtcgcagtgatgataggcaacttgaaaggcatggaacttctgcacttgattcagaaaggagtctatgtgaccatcatcattgaagtggggcgaatgcacatgccgtggctgagcc

SEQ ID NO: 11394 - DNA, 579 bp, Canis familiaris
gaacgcggaggctgtactttcacacacaaaatcaacgtggcagcagagaaaggagcaaatggggtgatcatctataactacccaggtacgggcaacaaagtgtttcccatgtctcaccagggaacggaaaatatagtcgcagtgatgataggcaacttgaaaggcatggaacttctgcacttgattcagaaaggagtctatgtgaccatcatcattgaagtggggcgaatgcacatgccgtggctgagccattatgtcatgtccctgttcaccttcctggctgccaccgtggcctaccttttcttgtactgtgcctggagaccccgggtgcccaattcttccaccaggaggcgaagacagatgaaagcagatgtgaagaaagctattggtcagcttcaactgcgagtgctcaaggaaggcgataaggaactagatccaaatgaggacagttgtgttgtttgctttgacatatacaaaccccaagacgtagtacgtattttaacgtgcagacatgtgttccataaggcatgcattgacccctggctcttagcccataggacatgccccatgtgcaagtgt

SEQ ID NO: 11395 - DNA, 328 bp, Canis familiaris
gagaaaaagcagcaccttgtccatacaagtccatggaagtttgctccttaacacgctattaaagcaaaacgcacgtctttaacagcttccacctatggaatatctgcgtgcagtcgtccaaccgggtgattataaagaggaacaccaaggcttcatattcacaattacattcagaaaaagccttacacgagtctatgaatacctgccagggactgtgcctgtggttcaagtgtcagcctcagactgcaggtcagctatgaagaaacaccccttctacacagaacattcctccacaactccaaaagttgacactgtccggttcatgtaa

SEQ ID NO: 11396 - DNA, 363 bp, Canis familiaris
gaagctcaagtgcttactccagcggctgcactctgcagaagcccattacgaagatgaccccaaaattgctttcctgatgcagctacaagacattcagtacctggtagagaacatctgggcttcccagtcagtgctcagcgccgggaatgatctcaatgatctggtcctggtcaggtgggatcggtctttggaatggtccccctggaactgcattcttcttaccaaagacgaaggtgttgctcatctcaagctaacaagtattgaggagggatatgaacccttgtttattcacaagatcaaacacaaacatatcctggctaagaactacttttctcacattccagtgctggcttcatttatact

SEQ ID NO: 11397 - DNA, 457 bp, Canis familiaris
  misc_feature (29)..(29): n is a, c, g, or t
  misc_feature (60)..(60): n is a, c, g, or t
  misc_feature (107)..(107): n is a, c, g, or t
  misc_feature (204)..(204): n is a, c, g, or t
gtggcattatcctgcagtcgtgatataancggtcaggccctatgctagaggtcggggatncagccagcctgcaatacttgggatgaggcacccgaggggtagagaanccgaagaaatgtatctggggtcgcacacaaaaattcgagcctagttctctgtgattccagaactaccttgaccaccacgtcatgttaatctaaaagnccagagagaagagaataatacagagaggaaaaagaaaggaattttgtgagccagttgtaaagaatgcacaggttaagagaatgcatgaggagaatatctgtgcaaatatgctaccaagccagtgagtaagatagagttcctgttttgagggatggaaggcagtaaatcaagcaacccccaggccacccaaacccttctaccacctataccagccctgtgcaaaacgaaaacttgttgccccttgttcaaagat

SEQ ID NO: 11398 - DNA, 446 bp, Canis familiaris
  misc_feature (363)..(363): n is a, c, g, or t
ctccatcttcgctactataggctaaatcggactgacttcccctatgaacgtcggcctcagtcacaagcccatattcctgaagatgagggggacttttattatgcaggggccttattcggggggtcagtgccagaggtttacaagctcaccaaggcctgccacgaagcaatgatggtcgaccaagccaaccacatcgaggccatttggcatgatgagagccacctgaataagtacctgctttaccacaaaccctccaaggtcctctcccctgagtacatgtgtaataacacactgaagaaaatctgggatcatcagggagtagacttttcttctaacataaagcggattagacttgtgactacngaataatcaccagaacatagggacttatcaaaggaagcttctagaaagaatagagacgtgatggtgaggcagccctagtcttc

SEQ ID NO: 11399 - DNA, 597 bp, Canis familiaris
  misc_feature (540)..(540): n is a, c, g, or t
tttctacttatctatgtacacaagaagtgaattttcaagcagatatttttggaaattgtggaaacacaggttgcagttttgggagtatcctttgtggaaagttagtttgtcactggacgcattcagaaatagtaccaaaatcatcagttcatgatgttcaatatacttaccttggaggccatatttgtttgtcagcccatgtaagaaatgacacaacatcttcagctatggatcttacccaaatgagcaatggcactatgtgtggatacaataagtattgttttgatggactctgcgaagacatcaataactacccaaatagaccaaattgtgagtcagaaaaaaattgcagtggacatgggatttgcaatgataggcttaattgtcactgtgatgttggatattctcctccaatttgtctcccatcaccatcatcaccaggaggaagttataatgatggattttggcatccacaaaagaaaagcaacaccttattcagaaagcgacatgctgctcctaaaaaaaatggcctcttgatcngtttctacatttttatacctgtccttattttaattgccattgttgcccttaaatgga

SEQ ID NO: 11400 - DNA, 150 bp, Canis familiaris
  misc_feature (94)..(94): n is a, c, g, or t
aaatcagttttaaggcagaagtcaattcatctggaaagactattgctgagccagacttaaaccactctttttcactaactgatttacaggatgntatacctacaacattccagggtgctacggccagtacctcgtatggagcccagaacc

SEQ ID NO: 11401 - DNA, 532 bp, Canis familiaris
  misc_feature (45)..(47): n is a, c, g, or t
  misc_feature (51)..(57): n is a, c, g, or t
  misc_feature (60)..(60): n is a, c, g, or t
  misc_feature (69)..(69): n is a, c, g, or t
  misc_feature (72)..(72): n is a, c, g, or t
  misc_feature (76)..(76): n is a, c, g, or t
  misc_feature (90)..(90): n is a, c, g, or t
  misc_feature (115)..(115): n is a, c, g, or t
  misc_feature (415)..(415): n is a, c, g, or t
aaatccccatgttgcccgcagaaacctccgtgccgcccacagaannncccnnnnnnnccncagaagccnccntgcngcccacagaagccnccatgcagcccacagaagccgccangcagcccacagaagccaccatgcagcccacagaagccgccatgcagcccacagaagcccccatgctgcattcagcccaagtgctgctgtctggagccaaaacctgaatgcacttgccttaataaggattctgagcccacatcacccaaaactcagagcaagaactctcaaacccaacagcaaccccaaagtccaaaaggaggacccaacctaggtaatttggggcagaagaagccaaataagtagaggggtatacccatcacttagtggggccaggctagacctacatttagaaaagctntttctcactgaccatcacttagtacaagcagaagcctctatttcccttcacaacatcccccttaggaagccccccaactggaaatggagccaaagagaccggagtcatctttcctgg

SEQ ID NO: 11402 - DNA, 44 bp, Canis familiaris
cgatagtaccaataaggcctaacatctcttgagtctctgggccc

SEQ ID NO: 11403 - DNA, 271 bp, Canis familiaris
  misc_feature (191)..(191): n is a, c, g, or t
  misc_feature (194)..(194): n is a, c, g, or t
  misc_feature (209)..(210): n is a, c, g, or t
cgagtgatctactgcggcctctgaagctatggccttcggtacattctactgaaaaaaagtctggaacagcaatttccaaactgtctactctttgaggaggagagagctgcccaggctacaggggagtttgaagtgtttgtggatggaaaactggtccattcaaagaagaaaggtgatggttttgtggatgnagnccaggctgcagaagnntatgaatgttatcgaggaggaggtcaggaaaaggagcctcagcaggatgccgagaagggct

SEQ ID NO: 11404 - DNA, 481 bp, Canis familiaris
ctgccagagagtttatgcgtgcgatttgcaatggaagatttgcctatcaaccagttgtatggaagtgactcattagaagaagccgaaaaggaaatacagtatttctttccttctcaagatactttagcactgattaagcctcacgtaacacatgaacaaagagaggagatcttgaaacttattagagagactggatttgaaataacacagatgaaggaagtagtcctaaatgaagaagcagcagaaaaaatttattcaaagataaaaggaagagacttttatcaggatgtattgcaaatgttgtctgagggtccatctttggtcatggttctgactaagtggaatgctgtttcggactggagacgattgatgggtcccatagacccagatgaggcaaaactactgtccccagactctatccgagcccattttggaagaagtactttgaaaaatgctgtccacggatcatctactatctatg

SEQ ID NO: 11405 - DNA, 295 bp, Canis familiaris
gctctgcagggcagcattcctggcagccatcctgctgctgctgcgggtcaaggtggtgaagcctcagaaaggcagcctggactccaacgagaagagtcagactgaggagataccctctacagaccaggacgaagatcaccttgaagagcactttgtggcctcctcagtgggtgagatgtggcaggttgtggacatggcccagcaagaggatgacaagacgtcagacacagcagctcttcgtgaccacctatttgaccttgtcttctgcttcaatctggccagcatcatggttttt

SEQ ID NO: 11406 - DNA, 353 bp, Canis familiaris
  misc_feature (32)..(32): n is a, c, g, or t
  misc_feature (119)..(119): n is a, c, g, or t
  misc_feature (264)..(264): n is a, c, g, or t
tgccatccaatctgacccttttcatctataancagtgcatgaaggaatagatgttacctctcctcagttcactagcatttggcccaagttgggggaaatgtgcagtattgtagaagtanccactgtcacatcatttcattcgatgtactccctgtccttctaaaagagaccacaaatagcgtgccatcctaaactttagtttgggacaataaggcaccaatcgggtgccatagagccagggatgttgtagatattcaggaattntatttccacttcctaggaaggctatccaagttattctgtgcacgtagcccatgtgttagataatgagaatcattttcatcctaaacgat

SEQ ID NO: 11407 - DNA, 496 bp, Canis familiaris
aagaaatccagctacggcccaaggtgaacgtgtcttcttacatccactttttgctgaattacaggaacaagttcaaggagcagcagccaaacacctacctgggctttaaagagttctctagaaagtgctcagaaaaatggaggtccatctcgaagcatgaaaaggccaaatacgaagccctggccaagctcgacaaagcccgataccaggaagaaatgatgaattacgtgggcaagaagaagaagcggagaaagcgggacccccaggcgcccaggcggcccccctcgtccttcctgatcttctgtcaagaccactatgcccagctaaagagggagaaccccacctggtcagtcgtgcaggtggcgaaggcctcggggaggatgtggtccgtgacgtcaggtgccgagaagcagccgtacgagcaaagagcagctgtcctgagggccaggtaccaggaggagctggaggtctaccgtcagcagcgtaacaccaggaa

SEQ ID NO: 11408 - DNA, 309 bp, Canis familiaris
atggtccctcctttggccccaggatgacttgctgcggggcatggacagcttcttctcagcccccatggacttccgaggcctccccagaaactaccaccaagaagagaaccaggagcaccggctggggaacaacactctctctagccacctacagatcgacaaggtgacagacaacaaaacaggagaggtgctgatctccaagcaggtggtggcatccattgagccgggagaggggagtttggagggtgactggaaggtacccaagatagaggagaaggaagccctggtgcctgtcccgaaagccatcga

SEQ ID NO: 11409 - DNA, 304 bp, Canis familiaris
ggcagtaccgactagcatatatcagactagcacggggcaatacattgctatagcccaaggtggaacaatccagatttctaacccaggatctgatggtgttcagggactacaggcattaacaatgacaaattcaggagctcctccaccaggtgctacaattgtacagtatgcagcacaatcagctgatggcacacagcagttctttgtcccaggcagccaggttgttgttcaagatgaggaaactgaacttgccccaagtcacatggctgccgccactggtgacatgccaacttaccagatccga

SEQ ID NO: 11410 - DNA, 519 bp, Canis familiaris
caaatacttagcttcacattctggctttgaatgtcttcggaacatccttcctgaaataccagtttataaacaaagacagaggagagtatgtggtaatgggaaattggaagaaggtgaacaatgtgattgtggcactatagagacttgtacgcataaagcctgctgtgaccctaggtcgtgtgtaataaaaactggtaaacaatgtggttctggggaatgctgcacgccagattgcaagctaagaccaggtggtataccatgcaggaaatctttggatgaatgtgatttcactgaatactgcaatggggtttcctcacactgtgtgcctgacacttatgcacgcaacggacaaagttgtgaatccggtgatgccttttgttatgagggacaatgtcggacagctagcaaacagtgtaaacaattgattggtggagcttctagaggtggttcatttgcttgttatgatgaaataaattcaagagcagatagatatggaaactgtggccgagacttttgtag

SEQ ID NO: 11411 - DNA, 531 bp, Canis familiaris
ggctacagtgttatcttttacatcttgatggatgacttctccaaactacctcccataaagttaggccccctgcgaacacttaaactatgtattatattcaaacaacatacgtggaaggacttaaattacatatacatgaggaacttcaatgtatacatcctagaacacatccagtatgaagttgactttctcttcagtatgtctgtaaaccagatcttcaagaatgactttggggtggaaaacctgggcaagtctgtagcccaactccacgcatggtggtattttggacatgccaaaaatttcccttatgagagaagatctaaatcagcagctttcatccctcctggagagggagatttctattaccatagtgcaatttttggtggcacacccggtgaggttttagccttcactgaagaatatataaaaggaattcaaaacgacaccagaagaggacttcagagcacatatgaatgttacctaaacaaatatttgtttatcaataaacccactaagttgttatcaccagaa

SEQ ID NO: 11412 - DNA, 546 bp, Canis familiaris
gtagcaaatgctaacgagcctggtatatttaaacagttaatggcagctgctgaagagcgcccatggctttggctcatttattttgtgacagcagggcttccaatagcattaattgcttcattttgttggccaagaaaagtcaagaaaaaatatgaagattcagagtataaaaagactgacatatgcaagccacaaacaaagggagcactagagcaagaagtgaaggaaaagaaagctgccctggagaaaccagtagacttggaagaagaaaaaaagcaaagtgatggtgaaactgttgaaaaagaagaggaagctgaacctgaggaaaagagtgaagaagaaattgaaatcatagaaggacaagaagaaggtaataaatcaaataagtctggatcagaggatgagatgaaggaagcggatgagagcacaggatctggagatgggccagtgaagtcagtgcgcaaaagaagagtacgaaaggaataaactatattcaagtatttttaattcctgagcgagatatttggcattctaaaatcagtgtgc

SEQ ID NO: 11413 - DNA, 576 bp, Canis familiaris
gatgacttatccaggatgccttggatacagctgagtcgcctccgtacgatcaaagtatttgaaataaagcgagagaagagatggcaagacatcagcatgatgcgcatgaagactattagtgaacatgttgtgaatcatatccagtatgaagttgactttctcttctgcatggacgtggatcaaatcttcatagggaaatatgggttggagactctgggggagtctgtggctcagttacatgcctattggtacaaggaagatcctaaagaggtgccatatgaaaggaatgagtcatcagaagcatatatacctattggtatgggagatttttattaccatgctgctgtgtttggtggcactcccatccaagtacttgatattgccagggagtgcttaaaaggaatcatgaatgacaagaaaaacagcattgaagcagtgtggcatgatgaaagccacttaaacaagtatttctttctccataaacctactaaactcttatcaccagaatattgctgggattatggtagaatgaatggtctttattatccaaatatcaaactctattgggccgtcaag

SEQ ID NO: 11414 - DNA, 326 bp, Canis familiaris
  misc_feature (150)..(150): n is a, c, g, or t
cctgctctgagcatccgggccggatccatccagcgccatggccagataccgatgctgccgcagccaaagccggagcagatgccgccgccggagacgcagatgccgcagacgaaggaggcgatgttgtcggaggcggagaaggagagtgtnctgccgccgctacaccgtggtgcgctgtaggagaagatgaatgaacgcccagactcgccagcccaccgcactccgctgcgcaaccaccagccaagacccccctgccgcctcctgaacatgccacccgctcgatgaagtgaacaggagcctgctaacgaacaatgccgcctgtcaat

SEQ ID NO: 11415 - DNA, 175 bp, Canis familiaris
  misc_feature (124)..(124): n is a, c, g, or t
ggaaagttatgagcctgcggtagctgaaatgtccgggcgcagagcgggctcccggggaggagggctggcgggagcgtcgagtcggagcccgggggagctttgataagcaaatgcagcccagcgntcgggcgctctctattggctgttccttcaccgccagattttgacacaaata

SEQ ID NO: 11416 - DNA, 403 bp, Canis familiaris
  misc_feature (171)..(171): n is a, c, g, or t
  misc_feature (173)..(173): n is a, c, g, or t
atcaacgagattgtctacttcctccccttctgccactcggagctcatccaacttgtcaacaaggagctgaacttctgggccaagagagccaagcaaaggcacaacatcacgctgctctgggaccgtgaggtggcagatgtgttggtcgacggctacaatgtgcactatggngnccgctccatcaagcatgaggtagagcgccgtgtggtgaaccaactggcagccgcctatgaacaagatctgctacctgggggctgtaccctgcgcatcactgtggaggactcagacaaacaactgctcaagagccctgaactgccctcaccccaggctgagaagcgtccccccaagctgcggctagagatcatcgacaaggacagcaagacccacaaactggacatccggg

SEQ ID NO: 11417 - DNA, 421 bp, Canis familiaris
tgaggagtatccaacccttacaaccttctttgaaggagaaataatcagcaaaaaacaccctttcttaacacggaagtgggatgcagatgaagacgttgatcggaaacactggggcaagtttctggctttttatcagtatgcaaaatcatttaattcagatgactttgattatgaagagctgaagaatggggattatgtcttcatgaggtggaaggaacagttcctggtcccagaccacacgatcaaagacatcagtggtgcttcctttgctgggttctattacatctgcttccagaagtcggcagcctccatagagggctactattaccataggagttcagaatggtatcagtcactcaatctaactcacgttcctgaacacagcgcacccatctatgaattccggtgacagcggttcaga

SEQ ID NO: 11418 - DNA, 111 bp, Canis familiaris
atcgcaaaatttgccatttgctaaaagaaaaagtcttagactgtttacactgccagaagatcagtcccaggtgtatcccaagaaagcactgttttgttgacaggcagcccc

SEQ ID NO: 11419 - DNA, 576 bp, Canis familiaris
gataggtttgggaactgcggtctaaaaagaggccagtatatattctgttcatggagggatcttcaatgtggaagattaatttgtacttatcctactcgagttcctttttacaaagaaaatagtgctgtgatttatgcctttgtacgaaatagtttatgtataactatagactacaaattacctcactcaaaacgagatccaatggaggtccccagtggcagtttttgtgatgaagacaggatatgtgtaaatcgtgaatgtctagaagcaaggatgcttagagctcaattaaggttttgttcagaggggtgcggagaacacggagtatgcacttcccaaggaacgtgccattgttttgatggctaccagcctccatattgtcaaaggcgtggcagagaagcttctagtttgtctgggaaacagggcaatgcttttagaaaggctgaaaagaaccggtggcttctaggtttctacattgctttacctgttctcatcatagtaaccataatagctgtttcatggaatagttcgaaaaagtggttcaacaaggaagaggaatccctaagtagcgagtaa

SEQ ID NO: 11420 - DNA, 548 bp, Canis familiaris
  misc_feature (26)..(26): n is a, c, g, or t
  misc_feature (51)..(51): n is a, c, g, or t
  misc_feature (54)..(54): n is a, c, g, or t
  misc_feature (59)..(59): n is a, c, g, or t
  misc_feature (62)..(62): n is a, c, g, or t
  misc_feature (113)..(113): n is a, c, g, or t
  misc_feature (125)..(125): n is a, c, g, or t
  misc_feature (145)..(145): n is a, c, g, or t
  misc_feature (181)..(181): n is a, c, g, or t
  misc_feature (185)..(185): n is a, c, g, or t
  misc_feature (205)..(205): n is a, c, g, or t
  misc_feature (211)..(211): n is a, c, g, or t
  misc_feature (232)..(232): n is a, c, g, or t
  misc_feature (239)..(239): n is a, c, g, or t
gttgggttgatgtctttgcgaaagtngccgactagacggtggggctctggnagnagggnagnaggggtccctatggtgggatgctgggtgtcctgtcattgggaactgtcccnttcccgtatccntactccatcctgggggcccnggggcagcgttcaagaagccaggaggcttcagagcncccnccaggctcctcagactggtnccatgnccagtaagaatctctttaagnaaactgnaaatgtgtgaccttgaggaagaggtgtactttcatgaggagagaaaagcccccatggtcgctggtggaatattgaagccagaagagccagaccatggcatcaagctgcgctgcaaatcccagacattcacaagtcctgggctgtagaatctctcccaagttttgctttgtttcctatcaatggtgttaacagctctgccaatgttcagcaattgtgcgaggaggacaatactcagagagcaaaatcagtacagtattgttttatttttatgccatatccagacagaaagatctcctctattcattgtaa

SEQ ID NO: 11421 - DNA, 531 bp, Canis familiaris
ataaataccaccatcacgcagctgactgcggagataacaaaaattaaaaagaacgtactgcaggctgaaaaggaagccaaggactcgaagaatgtgctggacttagcaaagcagcagtcagagctggaggatgggctttcccggctgcggaccacgttgcaaaggactggagagcgagccacccgggtgacagctcaggctgcatgggcccgaagccaggccgggggcctggagcaggagtttgcagagctgaaaaaccaatatgctgttcttcaacgtaagaccagcgctatgggactaaccaaggcgacgttggaaagagtggaacggctgaaagacgtggcagggaaactggccgaggatacagaggacaagataagaagaatagcagatttagaaaagaagatccaagatctgcagctgagtagacaagaaaaagctgaccaactgaaacagttggaagatcaagttgttgccattaaaaatgagatcgctgagcagggaaataaatatgctacttgctacagttag

SEQ ID NO: 11422 - DNA, 542 bp, Canis familiaris
gatacagccgcccattctagagtgtcttcaaccatcagtttagtaaagatttcaaaagatggtgaacaacctccagagaaagacacctcaaaggaccattttgcattgaccctgaagctgctgaggaaaatacatgacagaaaaggcaagaaaagaacagttcagaaacccataatgaggggcaagaagaagacaaaagaagctaagtttacaatcaatgaatctctggctgctgtaaaggaagagcgagtcgtgaagcagctgaaagccaaagggcggggtgcctctggagcgcctggccgcaaggccaccactgaagatggcgcatcatggcgagatgatctatgtcgtcttatgaccctgagaatatctggttcccaaacagaaatgtcagaggctctaaacatggaactagtgaccatggctcaggaggtactggcagataagcggcccagttgggaactttttcaggagatctgccctttgttggagaaaaaaagtgacattctgcttgaggacctagactgggatgtagcctggcc

SEQ ID NO: 11423 - DNA, 497 bp, Canis familiaris
atccgcctgggagtttatcaacctagcatcagaaataagaaagagcagatacggaactactcattgattatccctgcccctgagttcaaagcacagtctctggagaatgacctgatgctgataaaactgtccaaggccgctgtactcaacaactacgtggggaccatagccatatctatggagcccttaacatttaatgattcctgctttatcccaacctggacttggaatcaattcaaaaatctcagtgaccctgacatcctgacttggataaaccaacattctcatcccttcagtgactgcaggaatatgataggagagagaatggcagtaaacatcatgtgtgtgggacaacctttaagcatcatatctaaaaccaagccagaagtttcagctgctccagctgtctgtggtgggaggctacatggaatcttatcctgggacaaaggaagtgtcaccctgggaagtgaagggtttttcacagaagttcatcccta

SEQ ID NO: 11424 - DNA, 527 bp, Canis familiaris
gggtgatcacagctgcacattgcaacttaccaaaacttcgggtgatattagggattacaaatccatcaaatcctgatgaaaaggatgtacaagttgttggctatgagaggatgatccatcatccacgcttctcagttactgctattgagaatgacctcatgttaatcaagctgagagaaaatattgaactcaatgactatgtgaaagtggtcagtctgcctgaagaacctgtccgtgaggaagccatgtgcatggtctccacgtgggcctacaatctatgtgatgactccaaggagcccgactcaccacagagcgtgaacatatccgtaatctacagggatgagtgcctcgatgcctataaaacccaaaggatccaagaaaatatgctgtgtctgggcattgtgccaggaaggaggctgccctgcaaggaagtcacagccgccccagcagtctgcaatggggtacttcaaggaatattgacttttttagatggatgtgttttgagagctgatgttggaatctacacc

SEQ ID NO: 11425 - DNA, 126 bp, Canis familiaris
aggtatggattagaatgtctgttcaggttttatagttatggactggaaaaaaaattcagacaagaaatttttaaagatttccaagaagaaaccaaaaaagactacgaatctggtcagctgtatgga

SEQ ID NO: 11426 - DNA, 508 bp, Canis familiaris
aatgaataccctctttcgtttctggtcctttttcctcagagatcacttcaataaaaaaatgtatgaggaatttagacaacttgcttgggaagatgcaaaagaaaattacaggtatggattagaatgtctgttcaggttttatagttatggactggaaaaaaaattcagacaagaaatttttaaagatttccaagaagaaaccaaaaaagactacgaatctggtcagctgtatggattagaaaagttttgggcttacctaaaatattctcaatctaagacacagtctattgacccaaaacttcaggaatacctctgtagctttaagaggttagaagacttccgcattgatcccccgattagtgaggaatttggaagaaaaagacattcatctacttctggtgaggacagtagtcgtcatagacttccatctaattcctctgcaaagccaccaaatgctgctaagcctacatctgctaatcagcttcaggtccctgatccaatagagaat

SEQ ID NO: 11427 - DNA, 280 bp, Canis familiaris
ataaccgatgaaaatcctgtgcttgagcatcaagagtcaatgtcaaaaacccaactgcaagtaaagaaacaaaaaattgctaacagggaaagactcactattcagtatgaagtaccagatgaaaatcatgtgcttgagcatcaagactcaatgtcaaaaccagagattcaagtgaagaaacaaataattcaaaagagggaaagacttggtattcatgattatgtaccagacaaaaatcttatgcttaagcatcaagattcagtgtcaaaacttcaaatgc

SEQ ID NO: 11428 - DNA, 427 bp, Canis familiaris
  misc_feature (42)..(42): n is a, c, g, or t
  misc_feature (48)..(48): n is a, c, g, or t
  misc_feature (89)..(89): n is a, c, g, or t
agatagtcccatacctgtagcacgcgacacaggcatgtctgnaaaaanccgtaggttctgtaagtcttgcacagttggaggtggaatcncactattcctcagtacatatggaggcagaagcatcagttctgttctctgacacctctttgaaaggtcagcctgcacaattcccggatgcagggggctccaccaaagcagtcggctctgaaaaaccactgcatcttgaagtggagttcactgccctagttcctggcaactcggggcaggaggagtcccagggaagctctgcagcccaggagatggagggcaaactcgtgctctctggggaagctgctacagcagtgctctcggctgcatctgtaagggcagctggtggtagccccactcctgttccagaaggtcttactgaacctgagctcgaaccaga

SEQ ID NO: 11429 - DNA, 462 bp, Canis familiaris
aaagcaaaacctccaattacctcatctctctggaccccacagacctgtctcgggatgggaacaactttgtgggcaaagtcagatctaatgtcttgggcactaagttcaccatctttgacaatggggtgaatcctgaaaggaagaatttcgtcccggagaccgctcgcatcagagaggagctgggggctgtgtgttatgagcccaacatcttgggattccgaggaccacggaaaatgaatgtgatcattccagaaatcgatgcccagaaccagagaatcagtgtccagccacaaaacgggctggagtcactactgagtcgcttccaacggggggccacccagaggctcatcctgctgcaaaacaaaacccccttgtggagccaggagaacggcacctacgtactcaattttcacggtcgagtcactcaggcctcggtcaagaacttccagatcgtgtatccgg

SEQ ID NO: 11430 - DNA, 569 bp, Canis familiaris
gtgggaactttgattgcccctcagtgggtgttgacggcagcacactgctttttaccagatcttcagatcatcttttatggcagcttcatgaatcttcgagactttactggggagatcctacgttatgagaggatcttcatccacccaaacttcactgctacctctcctaaagatgacctcatgttgataaagctggctataccttttaccttcatctccacaaggcatttacagtggcctactttcaagaatgcagttaaagattgcttgattcacacttggttagagaataaatactttattggaaattcaaacaataatctgcaaagcatcacaattcaaatgagctctaatataaactgcaaaaaattattgggtgaaaaactcctagaagacatgttttgtataggacccacactaggaagtcaagaaccctgccaggtggtcacagctgcaccagccttatgtggccgtgaattacaaggaattttgtcttggggaactggatgtgttctaacaggatacactgttgtcttcactgacctacacagctacgttccgtggatcaa

SEQ ID NO: 11431 - DNA, 486 bp, Canis familiaris
cctgcgtgggtgttctcatcaaagacaactgggtgctagccccagctcactgctacttaccaaacctaaaagtgatgctgggaaatttcaggatcagagtcagagatggcacagaacagacaattaaccccatccagattatccgctactggaactttagccatacctccccacaggatgacctcatgctcattaagctggcgaaacctgccaaactcaacaataaagtccagcctctacccctcgccaccaacaatgtccgtccaggcaccatctgtctactctcaggtttggactggagccaggacaacaacggtagacatcctgatttaaggcagaacctggaggctcctgtgatgtctgataaagagtgccagaaaaccgaacaagggaaaagccacaggaactccttatgtgttaaatttgtgaaagtcttcagccgaatttttggggaggtggccgtcgctaccgtcatctgcaaaaaca

SEQ ID NO: 11432 - DNA, 507 bp, Canis familiaris
  misc_feature (37)..(37): n is a, c, g, or t
  misc_feature (45)..(45): n is a, c, g, or t
  misc_feature (115)..(115): n is a, c, g, or t
  misc_feature (213)..(213): n is a, c, g, or t
  misc_feature (304)..(304): n is a, c, g, or t
  misc_feature (451)..(451): n is a, c, g, or t
aagcgcttgacgtcgctgtgaccagccggggtcaccnccatcagncgcttggccgagttctcgaacaccagcacacccagctcccgagcatgggccagcagcagctcaaagtccncttgcgacaggaactggttatacaggacacctgcagtccgcagggcaggggcagcggagggccagcgtagagagaaaagccaagaacgtgaggccccngcgtggcagcctcggggcaggggtctgcgcttgccagccacctccatttcaaagctaatcctctatgcttgtctgttccaaagctcatccntaacagtagttgatccagccacattcagtaaggcaatataacacgggtgggtaagaaaacccactaatgctcaccaaaccagagaaactactgtgaattatccctcccaatttccctcttctagctaaatcccaacagcactgattngagacaatttactactacagactcactccccaaataaagtgtcctgccagctttcc

SEQ ID NO: 11433 - DNA, 544 bp, Canis familiaris
aattgtcagcactacacagcgagggggcagagagctggggctgaaggattcagacatggactatatccagactgatgccataattaatcacggcaattctgggggccccctggtgaacttggatggtgacgtaattggcataaatacactgaaggtgacagcgggaatctccttcgccattccctccgatcgaattcgacagtttctggcagaattccacgagcggcagttgaaaggaaaggctctttcacagaagaagtatctcggtctgcggatgctgcctctcactatgaaccttcttcaagagatgaaaaggcaagatccagattttcctgatgtgagttctggggtttttgtgtatgaggtgattcaaggaacggctgctgaaagctctgggttgagagaccacgatgtaattgtcagcataaatgggcaacctgttaccaccacaactgatgttattgaagctgtgaaggacagtgattccctttccattatggttcttcgaggaagtcaaactttgatcctgacagtcacacctgaa

SEQ ID NO: 11434 - DNA, 600 bp, Canis familiaris
accaatgtgccttatgtttatgctgttggggatattctggagggtaaacttgagctcacacctgttgccatacaggcaggcaagctgctggctcgaagactttttgcgggccgtttagaaaagtgtgattatgtaaatgttccaactacagtgtttactcctttggaatatggctgctgtggattatctgaagagaaagctattgaaatgtataaaaaagagaatctcgaagtaagattgtgttttgctgcttactttttcagaatttctcatcaactggctttgcagaaactttttgttttatcattaacccacggggcttctctttcttatgtttgcatattcaagtatcgggtgataggattccatgttctcggacccaatgccggtgaggttacccaggggtttgctgccgcaatgaaatgtgggctcacaaagcagctacttgatgataccattggaattcatcccacctgtggtgaggtgtttacgactctggagatcacaaagtcgtcgggactagacatcactcagaagggctgctgaggctagcactgctgctgtctgggtttccttgtcatttcctgctctcagggacaa

SEQ ID NO: 11435 - DNA, 505 bp, Canis familiaris
aatatggccagcctattcagatgaggtacatggaacatgaagagagaccaaaagctttaaacgacttgggaaaaaagattcagcttgttatgaaagtgatagaagcatacagaaacaaggatgaaagatacgatcatctggatcctgctgatgtggaaaaagttgaaaaatacattagtgaagccatgagttggctgaacagtaagatgaatgcacagaacaaactaagtctcactcaagatcctgtggtgaaagtttcagaaatagttgcaaagtcaaaggacctggataatttttgtaaccccatcatttacaagcccaaaccgaaagtagaggttgctgaagacaaagcaaaagctaatagtgaacacaatggaccaatggatggacagagtgggactgaaactaaagcagatacaacaaaagacagctcccagcatactaaatcttctggagagatggaagtggactaagtcttaatttcaccttcacataattcaaacag

SEQ ID NO: 11436 - DNA, 468 bp, Canis familiaris
  misc_feature (36)..(36): n is a, c, g, or t
  misc_feature (44)..(44): n is a, c, g, or t
  misc_feature (54)..(54): n is a, c, g, or t
  misc_feature (69)..(69): n is a, c, g, or t
  misc_feature (78)..(78): n is a, c, g, or t
  misc_feature (81)..(81): n is a, c, g, or t
  misc_feature (206)..(206): n is a, c, g, or t
  misc_feature (226)..(226): n is a, c, g, or t
  misc_feature (397)..(397): n is a, c, g, or t
ggcatatggccccagttccagaccattcaggagaangggggtcnccatcctgancagcaaggcgtgtgncaagatatnccncaagatctccaaagtccccaaaatggttcggatcgtggactccaagatggtctgtgcagaggactttgacagggagcagttttgctacgagataagtggtgagcccttggcctgttctgtggacnccatgtggtacctggtgggnctggtgagctggggccctggctgctcgaagagtgaggccccacccatctacctgcaggtcacctcctaccagcgctggatctgggaacgtgtcagtgggcaggaccttcccgccccatccagggccctgctcctggtgctatcactgccccttggcctgctctcggccctnctgacactctcatggtgtccctggggttgctgtcctcaccctctgtgctcaggatcctgcaggtgttgctc

SEQ ID NO: 11437 - DNA, 212 bp, Canis familiaris
gagacattcctatgaacttttcaagatgagtggtttatcctctccaatctgctcctgacagagcagtcttctgagccattcaatttcaaattgcaccaattatgtgcagagccttggtgtaaagtgctctctcactcattctttctctctgttgaatttggtgctattgtctcaggtacctgaaaccaaccagcctacaagaaccaaacaga

SEQ ID NO: 11438 - DNA, 220 bp, Canis familiaris
atagagatgggatggcccctatggtgaaatctaccagcagacccaaatggcaaaggctgccacctaaaaatgtttactactaccggtgcccagaccataggaagaattatgtgatgtcctttgcattttgttttgaccgagaggaagatatttaccaatttgcttactgctacccatatacatacacgcgctttcagcattaccttgacggcctgcaaaa

SEQ ID NO: 11439 - DNA, 122 bp, Canis familiaris
  misc_feature (9)..(9): n is a, c, g, or t
accagcccntgtacacctgtccccaccagccagggttttgggatcagagttgagttggaaggcagccactcgcaacagcatgcctggccttgtcaatgctgcctctgctgcatttgcaataa

SEQ ID NO: 11440 - DNA, 417 bp, Canis familiaris
atccatgaccgggtaaaaaatgtcttgaaatcacatcaggctcatcaaagacatttatatgatgagagagacccagagaaggaagacgaactggaactgaaaagaggtcttttatacagagactctgcctacgacagtgacccagagtatagctcatttcagcggccacgtggcactctccatttggatgatggtgaatactggtccaacagggcagcctcttataaaggaaaatcccaccgacccgtctttgagaacagcatggacaagatatacaggaacttatacaaaaaggcctgtagttccgtttctcatacacaggaaagcttctgataccatccatgataaactgtatgggtgtctgtgtcaacttctcaatgaaaacgtttgatgtgatcaatatctgtattctttttt

SEQ ID NO: 11441 - DNA, 176 bp, Canis familiaris
atggtgaacctgtgattggcgcccacccactgatttcccctcttcccctcccttctgacttccacagctcccctctccatatccttacagagccctaacattatcttcataccactcacatcaaagacatgtcatcttatgctagtcactggatttttcagattttcctgtccatg

SEQ ID NO: 11442 - DNA, 411 bp, Canis familiaris
aggttctgcctccaacagatctggggatgaaggctgccggcatcttggccctgattggctgtctgatcatggtcactgagcccaaaatctacactcgctgtaaactggcaaaaatatttttgagggctggcctggacaattaccagggttttagccttggaaactggatctgcatggcatactatgagagccgctacaatacaacagctgagacccagctggaggatggaagcattgactatggcatttttcagataaatagtttcacgtggtgcagacgtgctaagctacaagagaagaaccactgtcacgttgcctgctcagccttgatcacagatgatctcacagatgcaattctatgtgccaagaaaattgctaaagagacagaagggatgaactactggcaaggct

SEQ ID NO: 11443 - DNA, 39 bp, Canis familiaris
ccataaacttactttggtaggctctcaacctggggcagc

SEQ ID NO: 11444 - DNA, 329 bp, Canis familiaris
ctgttagataccctcctgggaacaaagcatgtggacagtgcagcactcatcaaactccaggagcgaagcttgtgtgtggcatcgccaggatttagtgtaatgcctggtgatgtccgaacacttgtgaatggattcgccaagaaccctttacaaaccagaagagaaggattgtatttcaaggaaaaggattacaaatgtatccgggcagatgactattctctttatgctaagaatgaaaaaactggtgtggtggttgtgaagacccatctatatcttctggtggcaacttacaccgaaggcatgtatcctagtgtttgtgtggaagccac

SEQ ID NO: 11445 - DNA, 89 bp, Canis familiaris
acaggcgccaaggactgtgtgttctgtgagctgaccgattccaagcagtgtcccggcatccacatgcagtgtggcgacgatgaggactg

SEQ ID NO: 11446 - DNA, 172 bp, Canis familiaris
gacgatgaggactgcttcacaggccatggggtggctccaggcctcggccctatcatcaacaaaggttgcctgctgtccacttcttgcggccacgaggagccggtcacctacatgggtgtcacctacacgcttaccaccacgtgctgctacggccacatgtgtaacagggccc

SEQ ID NO: 11447 - DNA, 130 bp, Canis familiaris
gaattgaagattgcaatgcaagccttaggatttgaaccaaagaaagaagaaattaaaaaaatgatagctgaaatcgacaaagaaggaattggcaccattacttttgaagatttttttgccataatgagtg

SEQ ID NO: 11448 - DNA, 504 bp, Canis familiaris
caggcatccaactattgtataggttcagaccaatggaagaaaagagcagcaaaacttgaattgaatgaaacccaaaagcaagaaattaaagaggcctttgatttattcgatgttgatgggtctggaaccatagatgtgaaagaattgaagattgcaatgcaagccttaggatttgaaccaaagaaagaagaaattaaaaaaatgatagctgaaatcgacaaagaaggaattggcaccattacttttgaagatttttttgccataatgagtgtaaaaatggtatatgaaaaaaatgaaaaagaagaaatattgaaggctttcaaattatttgatgatgatgatactggaagcataacactaagcaatatcaagagggttgctaaggaactgggggaaaatttaacagatgatgaacttcaggaaatgcttgatgaagctgatcgtgatagggatggagaaataaatgaggaagaatttttgagaatgatgaaaaagaccactctt

SEQ ID NO: 11449 - DNA, 51 bp, Canis familiaris
agagtaagcagtatgtcctcaagtgacaaattgacaagatgggaagtgctt

SEQ ID NO: 11450 - DNA, 303 bp, Canis familiaris
gggagcattgctgagtcactttatacagccagtttacatcagcagtatacttgttggtgatgggaattgcagtgatactagaggtttagaaattgctgtaaagcaacgtgttgatgatgcacttacttcaaaacttccaatgttttacttggtcaacagacctcatgttagtttagtaccttctgcatatccactgcaaacaaacttggaatataaatccttgagtctgaattgggcacagggggacatttctttggagattgtggatggcctgagtggaaagatcactgaaagttccccatt

SEQ ID NO: 11451 - DNA, 259 bp, Canis familiaris
gaaacatcggattatggagctgctgagctacctcaccagcgctctgctcttcttccggcctgaaaaaccaagagagtatttaataactatattggaacgactgagaattgccaaaataacaggcgtggcctttcctttctttatggatcactctaacattgtggctatgtttgagatgatggacacttcaagtaaaggcaccatatcatttgtgcagtacaaagaagccctaaaaaccctgggtctgttgaataaagat

SEQ ID NO: 11452 - DNA, 44 bp, Canis familiaris
aacatgtttatctgaaccagccttgggaaatgaacatcttaaaa

SEQ ID NO: 11453 - DNA, 576 bp, Canis familiaris
gatggctaccagaacaagaccgagtcctcaaagctccactgcgtcctcaatggcaacaatgtggcctgcagcttcaccgtaggagccggcctcctggctttcttcagctgcctgaccttcctcgccctggatgcccacgagagccgcatcggcagcacccgcttcaagacggccttccagctcctggacttcatcctggctgtcctgtggataggcatctggttcgtgggcttctgcttcctggccaaccagtggcagcattcaccacccaaagggttcctcctgggaagcagcagtgccaaggccgccatcaccttcgctttcttctccatcctcacctgggtgaggataggctacctggccctccaggacctccggaatgatactccagtcccttacaagcgctccctggatgagggtggcgtggtgctgaccaccctctccccgccctctgccaccagccctgtgaacacacccaccactggccccaacaacctgagttatgccggttctgcttcgtccccctatctgaccactccgaaggccccccgcctcgctatgatgcctgacaactga

SEQ ID NO: 11454 - DNA, 413 bp, Canis familiaris
aagccaaccgttgcagtttcctggtgccgcttgtcctggggtccgaagcatctcagcactagcccaggccaacgtcgagggacatcatcaccacgaatcccaggatggaggcccaggaggccagtttcccattaccactaggaaggaagggaaatgagaccttaacgcgctctgggacatcatccaagctgaaagaatcctctgcgatgtccaattccaacagaaaattaataaggacaataatattgataagcagcatctatcagggattactatatgccaggcgaactagctcacgtaatcccaaaggataatcacatgagaccggtactgtcagtgttcccttgttactggtggggaaactgaggcatacagatgtaacttgcccaaaggtacctctcatggctctggaa

SEQ ID NO: 11455 - DNA, 512 bp, Canis familiaris
  misc_feature (72)..(73): n is a, c, g, or t
  misc_feature (155)..(156): n is a, c, g, or t
  misc_feature (216)..(216): n is a, c, g, or t
  misc_feature (260)..(260): n is a, c, g, or t
  misc_feature (340)..(340): n is a, c, g, or t
ctgggccattcagaattccctgagaaagcaccagagaaaggcccctatataaccctattcaaaagcttctannatcccaatgtctggctgcagccttatctggtcttcaaccaaaagagacctgtactggacatattaattctgtgctcacttcnnctgatccctgcccttgtccgttaaggaaataccatgctcacagtcttcctgccaaggtgnccaaatgtggtgccatcagtttcactgatccaagaggtgttagncttggcaagttggaaatagcgagggaggcgaagagacgcttttccttgatgtgctcaaacaaagcagtacatattgtcanctccgcaggaggcgcgcggcggccatatgtgcgtcgcccagcgaaatggaataaacagctgctgccaggaatccaattgctggcaaggaagcaaacccaaggcctcctgtttccaaaataaaaatcaccagagggattccccttcctgcagttccagccagtagttttataa

SEQ ID NO: 11456 - DNA, 317 bp, Canis familiaris
  misc_feature (121)..(121): n is a, c, g, or t
  misc_feature (170)..(170): n is a, c, g, or t
  misc_feature (199)..(199): n is a, c, g, or t
  misc_feature (204)..(204): n is a, c, g, or t
gagaagctctggtgataatcacttcttcctaatagaattctcctctttcttgccgctttggaaatacactgtttttcaagacctatggattaaatacattttacatttattgcaaaactgnctttaaaagagggaatacatgttttcaacgtgacaaacccacgaaggcncaagtgatctcaggacagatcactcaggnaagcnccaaaggatgttcaaagttccacaggatgtctgtgcccaggaaagatcctggggagaggggcacaatgatttcacacaaccttgttccaggtggttattctctgcttcttctc

SEQ ID NO: 11457 - DNA, 121 bp, Canis familiaris
gcattgctgacataactctggtggctgggggctggagctggggagaaggctagctgagccttatctcattcctgcctcaggatgtgcaggggagccagcccactgcacaaatgtgaggatg

SEQ ID NO: 11458 - DNA, 285 bp, Canis familiaris
aaaacgagcctcagctggcgaatgccttcggcatccttggttgaattcttagcagattctacaaatcgagcattctgagctagcaaatgttttccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagcttagtagtttactgacccactttcttctggaaa

SEQ ID NO: 11459 - DNA, 153 bp, Canis familiaris
gtaaggatgagcaggcgagcaatcaaacaggagccctccctcgtggagaatttcctgtttaatttctactggggcaggaagaggagaatggggacgttccaactgctgtccctgttgcaaacctgtccttcccctacagccaatcgcaattac

SEQ ID NO: 11460 - DNA, 515 bp, Canis familiaris
cccagcatgttcgagaaggaggcatatgcacagattttaagagacagactgagagaatcatttcatgatgttcagtatgtagagcctccatttgatgaatcaattgctgatctaggtaaagaatggaagagtgtcctggcaaaactgaagtttgctaattcatatagaatggaaccattgaaaaaattccaagctcattcagtagaaactaaagtccagcagatattaaaggagagtcttaaggatgtcaaatatgatgataaagtcttctctcatttgtcacttgaattagcagaccgcatcttgtcagcagtgaaagaatttgggtaccaccgttacaagttcgttataaaagtattatttattcaaaagactggtcaggcaataaatatcgccagcagatggatctgggatgttgcatgggacagctgggttggggcaaaacatgaaacggaaacgtatgttgccttggccctggtgtttgctctctattgtgaatagctcattacatgtac

SEQ ID NO: 11461 - DNA, 588 bp, Canis familiaris
gtttagcttctagaagtcgctggaaagagcaatacaaggaacgggtggaaaattattctaatgtaagtattcacttgaagaatcctgaaaactgttcctgccaagcttgtggattgcatcgccactgcagatactcagtgcatttatcaggaaagttgtataacaccaggaccatggaaatagatgatttcatgtcacatgataaacaggtgtttactgttggcagaatttgtgctaatcgcaccagaatttatcataaactgaaacattttaagttcaagctgtaccaggaatgttgctccattgcaaagacagaagaagttgaggatgaacaggttaaggaaacagtggaaagaattttcaatcagtcaaaggaaagtggctggattaaggagaaatatggtcaacttcaagaatatctaaatttggcggattactttcaagatgagaagtttgactgaattgtaacacatttccttcagagaagattttataaattcctgtaaatgtgaagatcatgagtcttgtttctctgtatcatgtgacgtatttatatattttatgtgtactttcatggcaaatatcttg

SEQ ID NO: 11462 - DNA, 257 bp, Canis familiaris
gggactctgagataatgcaacaaaagcagaaggcagctaatgagaagaagtctatgcagacaagagaaaaatgatgactatggaaaaacctgggtgctactgccaactaggtgtatcaggctctaaggtcaaaattttgtggagcgaacaatcatatgttatatccttacaaaactattttagactttacctttcagcctgacttagtgtaatgtttcataagcattcttcaaataataaaacactaactgtgcatg

SEQ ID NO: 11463 - DNA, 172 bp, Canis familiaris
tggagaccctcttactcagaggaccccagaagccacagactcacccactggccgactaccgctacacaggttcagacatctggacccccatggagaagaggctttttaagaaggcgttctgtgcccacaagaaggacttttacttgatacacaagacgattcagacaaagac

SEQ ID NO: 11464 - DNA, 445 bp, Canis familiaris
gagtggtcaacagtgttcctattacaaagcaaagttcttcacgaagtggtaaaagtaagaagttgtcaggaacacctccctcctccaacagcgttaatgaagagctatcagaagtcttacagactttacaagatgaatttgggcaaatgagctttgatcaccagcagcttgcgaaacttatccaagaatccccaactgttgaactgaaggacaacttagagtgtgaactggaggcattagtggggaggatggaggccaaagccaaccaaataactaaagttcggaaataccaagcccagctggagaaacagaagatagagaagcaaaagagggacttgcgaaccaccagaaggactcttgatgaagaaggaaacagcagcagtcgatcctctggaaccacagggaccacaaacaagaaggatgttgccaagctgagacccggtga

SEQ ID NO: 11465 - DNA, 359 bp, Canis familiaris
  misc_feature (324)..(324): n is a, c, g, or t
gcagcctcattaatgcagatggacatgctgaaatatggacagattggaatgatatgtccaagtttttccaatatggatggagatgtaccactaatgagaattcctattcaaatcataccctgatgggaaactggaaccaggaaagatatgacctgaggaatatcgtgcagcccaaacccttgccttcccagtttggacactattttgaaacaacgtatgacatgagctataacaacaaaaggccactttcaactcataggtttaagagagagcctcactggtttccaggacatcagcctgagctggatcctcctcgatacaaantcacagaaaagtcaacttatatggctagctactca

SEQ ID NO: 11466 - DNA, 520 bp, Canis familiaris
gtgtccgaggcctacgaggtcctgtccgacaccaagaggcgctcggtgtacgaccgcgcgggctgcgacagctgccccttcgacgcgggctacaccttccggaaccccgaggacatcttccgtgagtttttcggcggcctggaccctttctcgttcgatttctgggatgcgcccttcaacagcgaccgcgcgggccggggccctgggctgcggggcgccttctcggcgggcttcggggagttcccggccttcatggaggccttctcggccttcgacgccctgggccgggccggcggtgccagccgcaccaccttctcgtccacctccttcgggggctccggcgccggcagctcagggttcaagtcagtgatgtcgtccaccgagatggtcaacggacacaaggtcaccaccaagcgcatcgtggagaatgggcaggagcgcatggaggtggaggaggacgggcagctcaagtcggtgaccatcaatggcaaggagcagctcaagcgggtggacaacaagt

SEQ ID NO: 11467 - DNA, 436 bp, Canis familiaris
  misc_feature (40)..(40): n is a, c, g, or t
  misc_feature (66)..(66): n is a, c, g, or t
  misc_feature (267)..(267): n is a, c, g, or t
  misc_feature (270)..(272): n is a, c, g, or t
gtctccggacactttcatatgcaggtcctcggccagggtncccgatgaccgtgccgggggcgtccncctcgaaggtgctgtatcgcactgtcttgctctgggccaccgagagcacccagcagaggctgaagagctgtaaagggaaaactgtcacggtacctggggctgggaactaacaggacacagccagaaggctgatatgggtgcggtgggcttcctcctcataggtgcggaatttgacagttttgatgcaagactcggacaccnagnnncagccgcagaactagcaagaattccagtctggtccagcataaagtgtcagcggaaaacctgagcttccagcaagccatctttgttcctcaaagagaaaaaagccaacaggaggttctgcactgatacttgcagcccctcatgccctcctgagtaggcagtcagg

SEQ ID NO: 11468 - DNA, 347 bp, Canis familiaris
gtgatcttatctacagctggacagtacctgtccgtctcttgtccttccagttacttttgtccatgtctggactcggctggctgttctgccagcaccttgctggttactgacctgatagtgatgcagccagaggcacctgagggttagcccaagggcccacatcctgggttggcctgtgaaagagcttagggtcctcgtctgggttttggtgatgttggaggaatactccccagcccaccacccccattcctttctgcttctggtttggagctctggaccagggctttagtcctggtcggtttttaaataattatttaacagtgtaacttttagacctgcgtgacatc

SEQ ID NO: 11469 - DNA, 161 bp, Canis familiaris
aaatgtgtgtcatcccatcaggcagtgtgtgctcctcacacctgtcatggtaggaaagctttacttcaagaaaaagttgagtatatgcaaagaaagccttttgtttctcatgttagcacatcttccatgtgctaatggcttctttgtaccatgatttgtat

SEQ ID NO: 11470 - DNA, 424 bp, Canis familiaris
  misc_feature (213)..(213): n is a, c, g, or t
  misc_feature (313)..(313): n is a, c, g, or t
  misc_feature (347)..(347): n is a, c, g, or t
taaggccatcttgacttttgacccactggatatacagattggaatgactaccacaaaggaagctttgaaaacctgcaatggtttccgaagaaaatctaggatgacaagtttttctcatctagtgaataaacagggaataaaggctatcaaagaagaggaattgcatgcagaagtctgctatgctgagtgcttgattctgaaatccactgtaangtttatacaagacgacagtatgtttgctttccttaaaagtgcaatcaacatcgggttaagttatcaaatatacaaagactgtcaacaagtattaacacanatacctaacaaccagagcaaaacctacagacatntggttggaggagtaaaatttggacttggagcattcaatctgatattatcacttgtgccaccaaagacccttaaacta

SEQ ID NO: 11471 - DNA, 552 bp, Canis familiaris
  misc_feature (71)..(71): n is a, c, g, or t
  misc_feature (82)..(82): n is a, c, g, or t
  misc_feature (86)..(86): n is a, c, g, or t
  misc_feature (92)..(92): n is a, c, g, or t
  misc_feature (97)..(97): n is a, c, g, or t
  misc_feature (119)..(119): n is a, c, g, or t
  misc_feature (125)..(126): n is a, c, g, or t
  misc_feature (137)..(137): n is a, c, g, or t
  misc_feature (147)..(147): n is a, c, g, or t
  misc_feature (158)..(158): n is a, c, g, or t
  misc_feature (164)..(164): n is a, c, g, or t
  misc_feature (196)..(196): n is a, c, g, or t
  misc_feature (201)..(201): n is a, c, g, or t
  misc_feature (203)..(203): n is a, c, g, or t
  misc_feature (236)..(236): n is a, c, g, or t
tattatgttgtcttctttgtctttgtataaggagaaagaaaaaagaagttccggctcaacctgataaacanccgcaaatggntccncctccncctgnaaagccagagaaaaaagtcccncctccnnccccaaagccncagaaaatgnttccaccttcncctgcnaaacctccacaaaaggctcctactcagcctgncaagncnccgcaaaaggctccgactcaacctgcaaagccncagaaaaaagctccgactcagcctgcaaagccacagcaaaagccttcagctcagttttcaaaatcacagcaacagctttcagctcagacttcaaaatcacagcaacagctttcagctcagtcttcaaaatcacagcaaaagctttcagctcagcctttaaaatcacagcaaaagctttcagctcagccttcaaaatcacagcaaaagctttcagctcagccttcaaaatcacagcaaactcttaagagtcaatctagcgtaacagttggcccaagtgggaaacaaaggccatcagtcacaaagaatgtacccaaat

SEQ ID NO: 11472 - DNA, 265 bp, Canis familiaris
  misc_feature (65)..(65): n is a, c, g, or t
  misc_feature (74)..(74): n is a, c, g, or t
  misc_feature (209)..(209): n is a, c, g, or t
  misc_feature (226)..(226): n is a, c, g, or t
tgccgggcctgcgtggacttcaagacgtggatgcggacgcagcagaagcgggacggcaagttcanggaggattntcctgaggatcgcgaggaactgggccgccacagctgggctgtcctgcacaccctggccgcctactaccccgatctgcccaccccagaacagcagcgagacatgacccagttcatacatttattttccaagttttncccgtgcgaggagtgtnccgaagacatccggaagaggatatgcaggaaccagccgg

SEQ ID NO: 11473 - DNA, 241 bp, Canis familiaris
gaaaaatgcttctactctaattagagagattgcaaaacatacacctgagctttcacagttgatagttaacgcaggaggagtggctgccgtgattgattgtatcgggtcctgcaaaggaaacataagactgcctggcatcatgatgcttggttatgtagcagctcattctgagaacctggcaatggcagtgatcatttccaagggtgtgcctcagttgtcagtctgcttgtcagaagaacca

SEQ ID NO: 11474 - DNA, 448 bp, Canis familiaris
  misc_feature (41)..(41): n is a, c, g, or t
  misc_feature (55)..(55): n is a, c, g, or t
  misc_feature (120)..(120): n is a, c, g, or t
  misc_feature (137)..(137): n is a, c, g, or t
  misc_feature (334)..(334): n is a, c, g, or t
cctgtagtgggcagcgatggctcctgcatgttctttgaggncagcatcatctatnccacacagatcgacaacctcaagcatacaccacctacagccagcccccagcccaaagaggtgacntttcctgagcttctctntatcctgggaagagatgttttatgcacaaaaatgtcaccgcttcctgactgacatcatcctggattccatcaggcaaaaggaccccaaagccatgacagccaaggtggtctccctgaccaaccagctgtggaccctgcacatcagccccaagcagtttgtggtggatttgctggccatcaccggcttcaaggatganccggcacacccaggaacgcctgtacagctgggtggaggaaatatggttgctgcatggacctgctcatccagaggggcctgtcaaggtccatctcttactctatcctgggcaagt

SEQ ID NO: 11475 - DNA, 207 bp, Canis familiaris
acagctgggtggaggaaatatggttgctgcatggacctgctcatccagaggggcctgtcaaggtccatctcttactctatcctgggcaagtacttacaagagggctagggtgaccagaaatgcgccctcacataccccccacctgccaaggctcattttaagaatgtgtgtgcccatctgaaggtgtgtcagtctatttttattata

SEQ ID NO: 11476 - DNA, 585 bp, Canis familiaris
gggtctcattgtactttggatttctggggctgtgttctgtggtaactggtggctgcattctctttctgcactggaggaagaacttgaggcgggaagagcgtgcccaggcatgggtggaggtgatgagagccgccacgttcacctacagcccactgttgtactggattaacaagcgtcggtattatggcatgaacacagccatcaacacggggcctccccctgctgccaccaagactgagactgaggtccagaattcagatcctctatgggagttggacatctctgagagcaggagctctgttgccgaagacagcagccccaaggtggagggccctgctctgctacaacctgcattgcagcccctactttccccaatgctgcagtcccagaccagctccccacttccagttcccatctttcaggaggtgcccttttccatttccctgtgcaacctgcctccagtgatgaaccactcagtctcctaccctttggacacctgtcctgaaaggaacatccacttccattccctacccacgatggcccatggagaccactgcttcaatgccaagccttttgcttcagagt

SEQ ID NO: 11477 - DNA, 397 bp, Canis familiaris
  misc_feature (26)..(26): n is a, c, g, or t
  misc_feature (51)..(51): n is a, c, g, or t
  misc_feature (60)..(60): n is a, c, g, or t
  misc_feature (79)..(80): n is a, c, g, or t
gaaagccttggcagttgttcccatcncggctttggttctggtatcttcacnggagccgancccctcctgggtcctcaanngcagccgccgaggccatgagcacctgttcatggggcgaggaccctggccctttcccacggccatctccttgtcccggcctgtcaggtcttccccgggtgcagtctgcttggggtggaaacctttaacctccgagatgacctgtgttcacaagagcagatgcccaggaccacagggacgtggtctccacgagagacgccccctctagcagccggctcgtgcggggctgtgagggcgcagggccctgacgcgagagctcacagcctaacgaacccttcattcgagattcccactgtcctgcgacataagcatcacgtga

SEQ ID NO: 11478 - DNA, 391 bp, Canis familiaris
gggcgatttagaccctggacagtacatgagtatggacttcactaacagggaacattcaaggcatacatctattaacaaactagaatatgagaatgaaaggctccgaaatgatcttaaacttcgtgccaatgacaaatcagcatgggctaaccaaaatacctatgaagaaatgggacgatacacctatcaaaaccaaataaaaatggaaaaacatgaacttagccaagatcgtgagccaaacagaagtgcaacgcctccactgccacctttgccatttcaaaccaaagaaatgacgagtcccctggttagtgatgatgaagtgttcccgctgtctcccccagatatagtcttcccagcctctttggctgcacagcattatctcctggaggaa

SEQ ID NO: 11479 - DNA, 530 bp, Canis familiaris
tacagagggtccttcgcagctatgtgcctcaagatatcagggatagaaatcgggttcgagtcacctcatgggatggcaggaagtggggagaactggagggagacacctatgaccgggtgctggtggatgtgccctgtaccacagaccgccattctcttcgtgaggaggagaacaacatctttcagcggtcgaggaagaaggaacggcagatgttgcctatgcttcaggtgcagctgctcgcggctggactcctcgccaccaaaccaggaggccacattgtctattccacttgttcactgtcacacttacagaacgagtatgtggtgcaaggcaccatagagttcctggccaatcaatacagcatcaaggttcaggtggaagacctgactcacttccgaaagcttttcatggacacattttctttcttcccatcctgccaggttggggagctggtaattccaaacctcttggccaattttgggcccatgtacttttgcaaaatgtgtaggctgacctagcatcacactatt

SEQ ID NO: 11480 - DNA, 443 bp, Canis familiaris
  misc_feature (105)..(105): n is a, c, g, or t
aatgtttgatcggaatgagcccagaaaacctcctgtgccactgaggactgatcatccagtcatgggaatacagagtgaaaaaaattttgtaaacacaaatgcagncgatgtcattatgggagtggctaaaaagcctaaaccaatttatgttgacaaaagaactggagacaagcatgatcttgaaacctcaggactagttcccaaatacatcaataaaaaggattatggtgtcacacctgaatatatatgtaagcgaaatgaggaagtaaagaaagcccaagaagaatatgataattatatccaggaaaaccttcggaaagcagctatgaaaaagctctctgatgaagaaagggaggcggttcttcaggggctgaagaagaactgggaagaggtgcataaggagttccagtccctctcggtattcatcgattccatcccaaaga

SEQ ID NO: 11481 - DNA, 477 bp, Canis familiaris
aacattcgccagaagaaactaatccacaagctgcaggaggaaaaggttttccgggaagagatgaaaatttttcgcgagaaaatagaagacttcagggaggagatgtggaacttccgaggcaagatccgtgctttccggggtcagatcgtgggcttttgggaggaggagagacctttctgggaagaggagaaaaccttctggaaagaggaaaaaaccttctgggaaatggaaaagtccttccgagaagaagagaagaccttttggatgaagtaccgtaccttttggaaggaggacaaggccttttggaaagaggacaccgccttatgggaaagagaccggaaccttcttcaggaggacaaggccttgtgggaggaagagaaagccctatgggtcgaggaaagagctcttctggaggaggagaaggcgctgtgggaggacaagaagtccctctgggaggaagagaacgccctctgggag

SEQ ID NO: 11482 - DNA, 390 bp, Canis familiaris
ttgctgctgtttctcttaggttccccattcctagtgactcatgggtcaagatctggagagggagtagataataatgaccagaaaaccatggagatcttcctctctgctaccgtggagtatgccttacatgtattcaacttgcagagcaatgacacgaaggcctacaggttggtgcgcatcctggattccaggatagagcaggagaagaagatgatggcattttccatggagctgcagcttaaaagaacaagatgtgggaaatttgatgaagatattgacaactgtccctttcaatcaagttcaggacagaacaatatcatcacctgcttcttcaccatcagcactgatccctggaatacaatatttgaactctggaacaagacctgcttg

SEQ ID NO: 11483 - DNA, 388 bp, Canis familiaris
  misc_feature (29)..(29): n is a, c, g, or t
  misc_feature (65)..(65): n is a, c, g, or t
  misc_feature (91)..(91): n is a, c, g, or t
  misc_feature (125)..(125): n is a, c, g, or t
atctacaggcccatcctctgggaagccancgacatgcccctgacgtggcagggccagctctccanccaggacttaaacaccgttctggaanccgccaacggcggcaggcagctgcaggtcttccnagccagccatctacaagtgcttcgtgcagcaggagctcatggctcggttcaaccccaggccctttcccgacgtgccggaggccctcagggaggaggaggcaggccggcagcagggggcgagggaggcctcgaaggggaaggccgggcctgtcctcaaggggctgaagttgacgctgctggtgggcatagtcctggggctgctggggctgctgctcaagttcttccaccattcccagggcaaaagaagtgaccaggtgctgctg

SEQ ID NO: 11484 - DNA, 491 bp, Canis familiaris
  misc_feature (60)..(60): n is a, c, g, or t
  misc_feature (105)..(105): n is a, c, g, or t
  misc_feature (141)..(141): n is a, c, g, or t
  misc_feature (167)..(167): n is a, c, g, or t
  misc_feature (201)..(201): n is a, c, g, or t
agccatacttcatctttgacattcatcaattgggcaagttgcccaccaacatgtggcttncctgcccttggcatccatctacaggcccatcctctgggaagccancgacatgcccctgacgtggcagggccagctctccanccaggacttaaacaccgttctggaanccgccaacggcggcaggcagctgcaggtcttccnagccagccatctacaagtgcttcgtgcagcaggagctcatggctcggttcaaccccaggccctttcccgacgtgccggaggccctcagggaggaggaggcaggccggcagcagggggcgagggaggcctcgaaggggaaggccgggcctgtcctcaaggggctgaagttgacgctgctggtgggcatagtcctggggctgctggggctgctgctcaagttcttccaccattcccagggcaaaagaagtgaccaggtgctgctggtgaaataaagcgaggcctcggtgccc

SEQ ID NO: 11485 - DNA, 491 bp, Canis familiaris
gtaccacatggcgacaccaactggagagagtggactcggggccttctaacactgcagtggcacgtgcacctgaaatgatcctacagcattccctttggcgaccagtgagaaacagagaaggtttaaaaactggatatgtatctaaaacaagatgtaaatcactgaagatttttagaaaaccaagcagactgttcatgcaatcagtttctacaaatgattctgaatcatacatgaatgaagaaaaaaaggaagaagatttactaaataaatgtatgcagtcaatgtcaattgaagaacaaggagaacatctgatgtgacctgacagtcttgtgaattgatgaggtgccaaaggggggaaggggttgtgaattgtgtcctctctttttaggatagtattgttattcaccatgaagtcattaagtaattttagtttgttcagaaacgtttgcaacagtgtaattggtttgatgtagttccatgtactaacgata

SEQ ID NO: 11486 - DNA, 459 bp, Canis familiaris
  misc_feature (33)..(33): n is a, c, g, or t
  misc_feature (45)..(45): n is a, c, g, or t
  misc_feature (47)..(47): n is a, c, g, or t
  misc_feature (87)..(87): n is a, c, g, or t
  misc_feature (90)..(90): n is a, c, g, or t
  misc_feature (116)..(116): n is a, c, g, or t
  misc_feature (206)..(206): n is a, c, g, or t
  misc_feature (336)..(336): n is a, c, g, or t
  misc_feature (380)..(380): n is a, c, g, or t
  misc_feature (392)..(392): n is a, c, g, or t
  misc_feature (429)..(430): n is a, c, g, or t
atgatttaatcaactgcgtcgtcgttgtaatgncgcctccatagnanccgaaggacaggttccgagagcttctgggtgagcgagcanccngggccggtgtgagtgctgcaggaggnagggcatggagctcctcggcccctcccggaccttgcactacgcctctcctacacctggctggtccccgacttacatgctcttataaaccnagccacgtagcggataagatgttcctccgagttctacgccaagcgatgacttacacagagaacgtgtctgcagaaagccaggccaccgctctgggcatctgttcccgtcacagaaaaagggaagaaaagngcagcaagaagaggccaattagggatgcccgggtagctcagcanttgagcatctgnctccggctcagggagtgatcacagggtcctgagatcnngtcctgcattgggctcctcacgcaagagc

SEQ ID NO: 11487 - DNA, 409 bp, Canis familiaris
gaccggtcggaaagctcccaaagcactttcccggcttgggcgagaggcacaagcccagtctctacttctgcctatgaggaagaagcagtaagcagtttggagatgccatctctgcctgagtatagatataaaagggccaacttgccacctgataagacaagagaattttcctcatcacaagatatcaatcagtatattcatgaaatttcagaatttcagaagaaaagtacaaacaaaattaaaaccttaagcaatatgttttgggggaatcatccccaaagaaaacgcagaggatattcagaaaagtgttgtcttacaggatgtacagtagaagaactgagtattgcatgcttcccatatactgaatacaaaaacttacagaaacaagtaccatcatttgtgactaaga

SEQ ID NO: 11488 - DNA, 289 bp, Canis familiaris
  misc_feature (47)..(47): n is a, c, g, or t
gggcgaagaaagctctacaggccttcatccgagcctatgcaacctancccccgggagctgaagcacatctttcatgtccgatcgctccaccttggtcacgtggctaaaagcttcgggctgagagatgccccccaaaagcttagtgtcacagctgtgaagagaaggaaagcaaacctgaacaggcctgaccttcataagaagagccacagtacacaccaccgccttgctgaaatcttgcgttccgaatactcaagtgggatggaggccggcatcgccaaggtcgaaaagc

SEQ ID NO: 11489 - DNA, 558 bp, Canis familiaris
  misc_feature (26)..(26): n is a, c, g, or t
  misc_feature (68)..(68): n is a, c, g, or t
  misc_feature (71)..(71): n is a, c, g, or t
acttactcgccttactcatggagagncagcaagggcatgctccttaagggacggaaatgtctgctacnaanctgacattcgttgaatacctactgtgtgtcccctttggaaatacgacagtctcaaaacagcagcactatgagtcagcagcagaaagcaagccaagatgatcccttttaaaacgactggaaattcttcacattttaatgttactatttagctgtaaatgggtggtgcatgtactagaccaaaattacagtcgttccgatttgagggcctgttctaaggctagttaatgcgcggcggtggagaacagtcacatccctcgctaccaagacgatggagcagccctggcctctgcagctgtttataatccttaagtcatgactcctccacctgtctgggtaaatctatccctgcaacaaatgcagacaacacttggagcgctcaagaatggctgtttacaagattctagtaggaaagttttgagcaaatcagagtgtaggccttcccatgtcattcatgtttcctcaaggcagacctttttcaatatttcca

SEQ ID NO: 11490 - DNA, 414 bp, Canis familiaris
  misc_feature (184)..(184): n is a, c, g, or t
  misc_feature (187)..(187): n is a, c, g, or t
ttttctgtctcagtgagttcaacatatactccatctgttagctctactgctgcccctgatgccaccactgcagctcatgccacccctgcagctcataccacccctgcagttccagccacccctgcagctcatgccacccctgcagctcccaccacccctgcagctcatgccacccctgcagctnccngccacccctgcagttcctgccaccatgaccaatgctgttcaaagcaccactcgagctggcttcttcagctcgatttggaaaatagtgggttgaaatattactaagatggaattagaggcatctgcatttgatcttgcagggctcagcacaaggcccatccatttgatttaatctagctgcttatcaagtctaccatctttatcttatccttaatcagtttatcggtt

SEQ ID NO: 11491 - DNA, 431 bp, Canis familiaris
  misc_feature (89)..(89): n is a, c, g, or t
tacctgacatctgttaccgctgtggtaagtctggtcatcatgctaagaattgtgaccttctcgaggacatctgctacaactgtgggagnaagtggccacatcgctaaagactgtattgagcctaaaagagagagagagcagtgctgttacacttgtggccgaccaggccatctggctcgtgattgtgaccgtcaggaagagcagaagtgctactcttgcggtgaatatggccacattcagaaagactgcacccaagttaagtgttaccgttgtggcgagacaggccacgtggccatcaactgcagcaaaacgagtgaagtcaactgttaccgttgtggcgagtcgggacatctggcccgggaatgccccattgaggccaccgcttaatatttcccctttgtcttccccctcttccgtttactgattgataa

SEQ ID NO: 11492 - DNA, 79 bp, Canis familiaris
tgcagaaaggcgtgtttccgaggcgggaactgagcgcaacaggggagcgcagggcagtcataaagcgtttgggcaaaca

SEQ ID NO: 11493 - DNA, 135 bp, Canis familiaris
  misc_feature (79)..(80): n is a, c, g, or t
caataaatctagtgaacccaagaatgagcccaagaattgtgatcccagatgtgaacaaaagtgtgaagccaaatgccannccagctgtttaaagaagctgctgcaaaggtgctctgaaaagtacccacgagaaaa

SEQ ID NO: 11494 - DNA, 141 bp, Canis familiaris
gtatcagaacctcttaactcatctcaccaaagagaaactgaagtactcagacaagcacattcctcaaaaatacctggctctacaatgggaggtctagacaaaaacagtgcattacaggcagttaagcctaactttcaacaa

SEQ ID NO: 11495 - DNA, 442 bp, Canis familiaris
  misc_feature (30)..(30): n is a, c, g, or t
  misc_feature (36)..(36): n is a, c, g, or t
  misc_feature (78)..(78): n is a, c, g, or t
  misc_feature (157)..(158): n is a, c, g, or t
  misc_feature (214)..(214): n is a, c, g, or t
  misc_feature (218)..(218): n is a, c, g, or t
  misc_feature (230)..(230): n is a, c, g, or t
  misc_feature (241)..(241): n is a, c, g, or t
  misc_feature (300)..(300): n is a, c, g, or t
  misc_feature (416)..(416): n is a, c, g, or t
acctcactcgactacttgtcaagttcactnccaacncaaagggggcatagaaaatcaaagaatgtcgagtgatgatancaataaatctagtgaacccaagaatgagcccaagaattgtgatcccagatgtgaacaaaagtgtgaagccaaatgccannccagctgtttaaagaagctgctgcaaaggtgctctgaaaagtacccacgagaaaangtgnccagcaccaccnaaagtgcccanccgtgccccccaccatgcccttctccatgcccgacttcctgcccccccaagccctgtgncaagccctgtcctcctaaatgcccatctccctgcccacccccagagtgaggtaccaagggtaccactcaacccactacctccaacatctctaccatgttcaccatcttggtgttgnaaagctgaagccatgaactgacaagt

SEQ ID NO: 11496 - DNA, 109 bp, Canis familiaris
atggccgtgtttcacgacgaggtggagatcgaggacttccaatatgacgaagactcggagacctatttctacccctgcccgtgtggggataacttctgcattaccaagg

SEQ ID NO: 11497 - DNA, 256 bp, Canis familiaris
  misc_feature (161)..(161): n is a, c, g, or t
  misc_feature (163)..(165): n is a, c, g, or t
agcttctgtattcttgcttcctcgagtgcaaccatcaagaataaaaagtgttctcctacctctctgcctggctcgggtttcctgggacttatcccttaaagacaactgcatttatcctaagccctcagaggacactgggcagtagcctcacaagcaaaccncnnncagagagcaaccactatagatgcttgctctcaggaggttcatgccaaagacccacaggctggcgcggggactccttccatagtcagaagct

SEQ ID NO: 11498 - DNA, 164 bp, Canis familiaris
ttgtattaaagtcgctttcctccgcaagcccgtggggagaagtcgtctggcttgccgagttccctgcttccgttttgtgagctcttgagttagaggacttgctatcctcttaccccccagtttgtctagatacttctatttccaaatttctggctcaattatag

SEQ ID NO: 11499 - DNA, 459 bp, Canis familiaris
  misc_feature (27)..(27): n is a, c, g, or t
  misc_feature (60)..(60): n is a, c, g, or t
  misc_feature (83)..(83): n is a, c, g, or t
  misc_feature (91)..(91): n is a, c, g, or t
  misc_feature (98)..(98): n is a, c, g, or t
  misc_feature (131)..(131): n is a, c, g, or t
  misc_feature (136)..(136): n is a, c, g, or t
  misc_feature (150)..(150): n is a, c, g, or t
  misc_feature (244)..(244): n is a, c, g, or t
  misc_feature (272)..(272): n is a, c, g, or t
aaggcccaaagtccatgtggtcagccnctaggaggctctcagcttcccttaggccttccntgtcagaggggtacaggatcccnctgcaacnccatccnagggagaattgagcccagtgagaaattcagagnccccncccaggggaagaangtggaaaagacatagtttggggaaatgagtttgctcacggtgtttgttttggacgaagccaacatgtttcatctggtaagtgcgccccgcatcnttttactgcttgagttaccagtaatctngcaagctgacgtaaacatctcgaactgaaggggacaattttaaacgaatgaacgaattcagaatttgtagctctctaaactagatgatttcggcctagaaatcctaacttgcatctggattgccaaccctgcgtctgtgcatcacttgaaatcacagccaacgccaccgtcgttgacgctcgtgaag

SEQ ID NO: 11500 - DNA, 521 bp, Canis familiaris
accagatgcattgtgaggaccttgaagaataccaggctctgaccttcctgaccagaaatgaaatcctgtgcatccacgacaccttcctgaagctctgtccccctgggaagtactacaaggaggcaacactgaccacagaccaggtcagctccctgccagccctgagggtcaacccttttcgagaccgaatctgcaaagtgttctcccacaacaatgtgttctcctttgaggatgtgctgagcatggcatctgtgttcagtgagcaggcctgccccagcctgaagatcgagtatgcctttcgcatctatgattttaacgagaatggcttcatcgacgaggaggacctgcagaggattgtcctccgactgctcaacagtgatgacgtgtcggaggacctgctgaccgacctcacaaaccatgtcctgaatgagtcggatctggacaatgacaacatgctgtctttctcggagtttgaacatgcgatggccaagtctccagacttcatgaactcctttcggatt

SEQ ID NO: 11501 - DNA, 578 bp, Canis familiaris
  misc_feature (203)..(203): n is a, c, g, or t
gatctgggagaatgactggctgaaaagagagattgcaaatcacagaaaggaagttgaagaactggaaagtactattcatgaattggaagaagaaaatttggtgcttattgatcaactattcaactgtagacttgtggatctcaaaatacccaggcaactctatcttactcaagctgctggactggaagcaccacataaagtgnctctggagttgccagaaatacatgaagaagagtcaaaattacaacccgtagaagttaaaagtacagacatcatgagctcatcatctgagagcagtgctttatatctctgtcatgaggatagtatcagatatgtcaagcacctgaagatagatgaagaagacaactcatgtatggaatttggggcctctgatatgaaatacttactatatgaggatgaacaggatttcaaggattatgtaaacctgggtcccctgcaagtgaagctcatgagtgtggcgagcaagaaaatgccaattcattttcaagaaaaagaaattccagtcaaatgctatgaagataccaggagcccagaaagccgcatcacatacaaaatga

SEQ ID NO: 11502 - DNA, 290 bp, Canis familiaris
  misc_feature (111)..(111): n is a, c, g, or t
  misc_feature (136)..(136): n is a, c, g, or t
  misc_feature (165)..(165): n is a, c, g, or t
  misc_feature (205)..(205): n is a, c, g, or t
ccccgcagaccaaaaggagtagtagaaaccctgtctttcatgattcctgggacacagagtcttcaagcagtgatagtggtgggagcagcagcagcagcagcagcagcatcnacagcccggacagggcaggcgggcnagagagcagcttgaaccacacggctgctnggtccggccctcacacccctcagcctgttcccgagcagtncgcactgtgccaaggcccttacttccacatcaaccagaccctgaaggaggcccactttcatagcctacagcaccgaggacggcct

SEQ ID NO: 11503 - DNA, 166 bp, Canis familiaris
actggctggaaatcccctgcttctctgacgatgtctggaatggctggtctttttagcatctctggcaagatatggcatcttcacaactatttcacagtgacccttggaattcctgcttggtgttcttacatctttttcgtcatggccaccttgatttttggccttt

SEQ ID NO: 11504 - DNA, 385 bp, Canis familiaris
tcaagatgaaggtccgggtttacatttgttcactccaagggagacagcctgcagtgagctgctttctgcatcacagtcccataatcaaagcctcacctctctagctgtcagattttttcaagaagagaaagcagaagcctgcagtcctaaccaagtcctcaatgtgaaggcattaacagagaacagtgaacgagcttctatgcagcacagatctggctgtgggccccaagtatcacaccatgggtgccagcagaccttacattcagtcctgcctcacgcctcctccagccccttcagtcagatgggcgttgttgataggaagaccctttcaagcaccctggggctggagtggtttccagagctctatcctggttatcttggacta

SEQ ID NO: 11505 - DNA, 246 bp, Canis familiaris
ctgttggagcagaggaaggcctactgggtgcagacagaggagaagataggccccggggaggaaaacaagacagcccccttgcctcatgaggaggcccatgtgcctgggctgctgccagaccagagcacaggcctctcctcaccttttgaggagtccaaggggccgtcgaccccccaggaggactccaagacactccgggtcctacgccagatggtcggtaacctgtctgggtcttctggggatgaa

SEQ ID NO: 11506 - DNA, 577 bp, Canis familiaris
  misc_feature (162)..(162): n is a, c, g, or t
caggatgctgccatagagaatgccaaacttcagtgtgggaatctggaaactcaaatcaaatccttacatacagaaaatgtaaagcttcaatttgacatagaagcagcccaggaacactttgaggaatatatgataaaatataatgaatattatacaaaaatnaaagcgcataaagatagtttggtggaggtagaaagcaaatggtcactgatgactgcactccatgaaaaacgagagcttgttaaaaaactaaaaacaatgaaagaggaacttatgcaaaatctccaaaatccagaaggaaatcacataaaacaagtacaggaagacattacaaagctaaaggatacaattatcactgtaaaagaatctatcattgaaaaaacttattttcttgaggaagaaaaaaagacacatgaaaaattaagaaaagaaatagaggtgcaacataagagatacagtgcaattcttaagcgtttgcattgtcaggtgaacaagcttcagtcaaatagaagacaatggcaatggaacattcaccaactagaaaaaactgcagctgaactaaggaaacgcattggaa

SEQ ID NO: 11507 - DNA, 326 bp, Canis familiaris
ttatccaacgcaaggccatctcaggctatgctggcttcgtccctcagtttgcctgggtgatgggggtcaattaccgcgagggtgtcacacaggctatggatgaatttgacaagaaccagttcctcttcagaaaccccatctgtgccctgggtgaaaggctgcccagaacacactggcccagcaacaccatctatagcagccaaggcctgatccctttctacatggggttcataccatccatgcaagacaactacgcaatgacatttggcaacagtacccgcagggcctatcagaaggaaatggagaggcaacaccagacactatga

SEQ ID NO: 11508 - DNA, 247 bp, Canis familiaris
tggctagttctgacgtgaaaccaaaatcaataagtcgtgccaaaaaatggtcagaagagatagaaaatctgtacagatttcagcaagcaggatatcgggatgaaattgaatataaacaagtgaaacaagtttctatggtagatcgttggccagagacaggatacgtgaagaaactccagagaagggacaatactttctattactacaacaaacagagagagtgtgacgacaaggaagtccacaaagt

SEQ ID NO: 11509 - DNA, 417 bp, Canis familiaris
  misc_feature (44)..(44): n is a, c, g, or t
  misc_feature (82)..(82): n is a, c, g, or t
  misc_feature (92)..(92): n is a, c, g, or t
  misc_feature (130)..(130): n is a, c, g, or t
  misc_feature (161)..(161): n is a, c, g, or t
  misc_feature (182)..(182): n is a, c, g, or t
  misc_feature (184)..(184): n is a, c, g, or t
  misc_feature (201)..(201): n is a, c, g, or t
  misc_feature (276)..(276): n is a, c, g, or t
  misc_feature (386)..(386): n is a, c, g, or t
atggctgggctgccccgcaggattatcaaggaaacccagcgttnactggcagaaccagttcctggcattaaagcagaaccanatgagagcantgcccgttattttcatgtggtcattgctggcccccagngttccccctttgagggagggacttttaaacnggaactattccttccagaagnanacccgatggcagccccnaaagtacgtttcatgaccaaaatttatcatcctaatgtagacaagttgggaagaatatgtttagatattttgaangataagtggtccccagcactgcagatctgcacagttctgctatcgatccaggctttgttaagtgctcccaatccagatgatccgttagcaaatgatgtagcggagcagtngaagaccaacgaaacccaagccatagaaaca

SEQ ID NO: 11510 - DNA, 336 bp, Canis familiaris
ggactgtgaggcagttactttccagacttctatccccagaccatcaattattgaaatgccagcggaagaaggatcccaggaggagcctaaatgcctcgagttggaacagaagatggcatcagacggcccatctgaggataccgaccttaaggatacatatctcatcccaagaaacatcatggccgagccagactacatagaagatgacaatcctgagctaattaggcctcagaaactagtcaatcctgtcaaaacgtcccgcaaccatcaggatcttcacagagaacttctcatgaatcaaaaaaggggtcttgcccctcagaacaagccggaact

SEQ ID NO: 11511 - DNA, 350 bp, Canis familiaris
  misc_feature (48)..(48): n is a, c, g, or t
  misc_feature (280)..(280): n is a, c, g, or t
ggagggagcctatcttaactgccactgtgatgaagaaactattcaccncaatcaagaagctctgctttctttctctccaactatcctttttgttttaagtcagcatggcatgcctgggagcatgcagtacctgctaggcaaactcctcatgttagccatgagattattattattcagaagaggaggagacttctctctacagggccacaacagtggaagaacagtcagaagctactggaagacttggccagcagtcctgaatccttctgaagagttcaancaaaaaatatgtgtggtacatgctctgaggaccaagcaggaactctacaacctgggtttgcctttgtgag

SEQ ID NO: 11512 - DNA, 435 bp, Canis familiaris
  misc_feature (346)..(346): n is a, c, g, or t
  misc_feature (366)..(366): n is a, c, g, or t
gccattggtataagtcaagagcatcatctgctttgggttttcagtgctgactaaagacatgtgaataataggaccttcattatgggtgacattatgggtgaagaagtaatggtttacctgaaacattagtattttctaagagttctttttgatggaatgagattttctcatcaacttatgtttgtctttttttccttcttctcaaacttggctagaagcagaaactattaaaatagtattgccatgatagatggttttgaagccatttctcttaaaataacaaattgtcatttgggaaaattctttgtgtttccaagtaaattgtgaaaattcttgatttactggntgaaattctggttacttggntgtcagtagcaaagtttacatcaggaataaatccccactgacatgtgaagcatgaaggttcctctggct

SEQ ID NO: 11513 - DNA, 367 bp, Canis familiaris
  misc_feature (28)..(28): n is a, c, g, or t
  misc_feature (36)..(36): n is a, c, g, or t
  misc_feature (48)..(48): n is a, c, g, or t
  misc_feature (66)..(66): n is a, c, g, or t
  misc_feature (70)..(70): n is a, c, g, or t
gccagagctgaacttgagtcagtctgcncatgtttntaatatctagcnatgttattctttcagacncttnttttagtctttcttttcaggaaaaaaaaaactttcaagttacctggtctttggatttagagtaaaaaagaggggcatgttacgtatcagatttaagagactaataccattagaagttaccaagttttaatagttggagaaagttttggtttgtacagagaaaaataatatgcagcagctttgctgctgttggaaaatcagttattggaatttccccttaaacagctatacaacaatattactggtagttctataataaaaatgagagtgtgttctgttgtacagagctaactgcaat

SEQ ID NO: 11514 - DNA, 150 bp, Canis familiaris
catcaagttaaagtgactaagcaacatcaaaagccataggttggagaaagactattaaccaagacattcaccattaagtgatctgattttataatgaaaaaaatctgctattctctccttttgttatggcttaaagctttcaatttcaca

SEQ ID NO: 11515 - DNA, 174 bp, Canis familiaris
gatcccgatcacaggtaaagttacggtcatcagtgagtttcaaatgggattcaaccttatcatgtaaccagaaccttgtaggttagtggtttgtggactccactaagagcaaggatattcaacagctacgcactgaagcaggcgattaatcctaagagccaaatgtgcaagctt

SEQ ID NO: 11516 - DNA, 251 bp, Canis familiaris
  misc_feature (182)..(182): n is a, c, g, or t
gaatccccaaatctcggagcctggatttgcagaatctttgatcttgcctccgccctctgagcccctgctgcccctttctgggggggtacaataggcagttccttccaaggagatgtcgattccattctccaacacccactaccgaattccacaaggatttggcaatcttcttgaaggactgngacgggagattctgagggagcaaccagaaaatataccagcttttgcagcagcatattttgaaaatcttc

SEQ ID NO: 11517 - DNA, 391 bp, Canis familiaris
  misc_feature (73)..(73): n is a, c, g, or t
ggagcaagaatcacctgagaattgtgagtcagaaaaagaaaaatctcccccatctgtgaaagaggatgagacnccagtcacagcctttgaatcttctgaagaagaaaaacaaagagaggaggatgctgctctcaaaatccaagcagccttccggggacacttagccagagaggaggtgaagaaaatgaagtcaggtgatgctgaaggagagaaaagagagggaaatgagtgagaagactggttttactcccccgctccccagaaaaacatgaaaaaatcatccagatccatcagcctcgctgtgattgttgtttttttcttagtaagggagatgtgatgtagtgaaataacatttgttgctgttgtgaaaatctgtcatgagcatttgttt

SEQ ID NO: 11518 - DNA, 184 bp, Canis familiaris
  misc_feature (126)..(126): n is a, c, g, or t
ttgatttgaaacatcaggctgcatcaacagactcaccagacccagtttttcctcagtgcagtgtgtgtgtataccacttatggggtaaacagagttatttatcaacgttactacttcagtatttcnacttctattttatacagtaatattcttaaactagctaaaacttcaaatgtatacctta

SEQ ID NO: 11519 - DNA, 207 bp, Canis familiaris
  misc_feature (80)..(80): n is a, c, g, or t
gagatctggtggtgaatgtcctgctgacccccttccatgtgaggagctatgtgacagggatgagtcctgtccccagggcnaaaaatgctgtagcaccggctgtgggcacgcctgccgtggagacattaagggcggggtggtgattgtccaaacattttggtgggcctgtgcattgttggctgcatgatggatgagaactgccaggct

SEQ ID NO: 11520 - DNA, 301 bp, Canis familiaris
gagagctccaatcagactcaagcccatcttgtaacaactgagctgcagttccctgtgagctatgtggaccgcctcctgcaggaagatcagcgcacccactgcctaagttcaacatctactgaattcctccttgccatgctcgactccctcaccgactacatcctggagcgtgtaggcactgaggccaataacaacaacatgcagactgccccacaagatgtggagagagcagtgggcagcaacagagagccccaacaatgcctgaaggatacagccttcactctgtttgatgagatgccta

SEQ ID NO: 11521 - DNA, 105 bp, Canis familiaris
gatccaggagaaatggctaaagcctgggtcctagacttgtgggagtcctcacagccttagtctaagccaagacttcttataactgagaagtctggcttctgtcat

SEQ ID NO: 11522 - DNA, 268 bp, Canis familiaris
aagggccattcccatcagatgttgagcagcaggctaatggatccccagcagggtgcaaagacagcagaaagcacaggaatcagatgtcaatgtgttccttcaagataccctgctaggacagagctaactaaccgggctttagtcttctcttggggcacacgctctgatggttcgcggcccactctggacttcctatacgcttcctgattaaaatgctgtcacagataaatcatgacttctgcctgttaggaccatttactgttctctt

SEQ ID NO: 11523 - DNA, 90 bp, Canis familiaris
gaggagattcagttccttaagcggacgaatcagcagctgaagcccaactggaaggcattattgcaccaaagaagtgatcgtttccacatg

SEQ ID NO: 11524 - DNA, 441 bp, Canis familiaris
  misc_feature (65)..(65): n is a, c, g, or t
  misc_feature (129)..(129): n is a, c, g, or t
gccctgctttatgtgatgattctcatcgccaagtccccgctggctcccttcacctcatttgcctncaccatcaagaaggaaggcctggttctacaaggccaacagaggccgtagctatggactctatgnccattgtctagagctgctgggggcacaatttgtgaaatgaaacaggatggtgctacttggaagaaggaaacggaagccaacataatggggattaattagttgattgatgttgagatggtaacagatttgcccccataccatttagccagccatctcagacctagcagggaaggtgaggatgaagaagcctttgttcaggtctgtagatgcgtggggctgaaggctttgccaccatgggatgtcaacagccataataataataatttgcacttatatagcacctttcaactgggcacctcaaagcggtttagc

SEQ ID NO: 11525 - DNA, 435 bp, Canis familiaris
gtggacagtcatagcacccatgagaagcaggaggagtggaataggtgtaattgcttatggagaacatgtatatgcggtaggtggctttgatggagcaaatcgacttaggagtgcagaagcctacagcccagtggctaatacttggcgcacaatccccactatgtttaatcctcgtagcaattttggcatcgaggtggtagacgacctcttgtttgtggtgggcggctttaatggcttcactaccacctttaacgtggagtgctatgacgaaaagacggacgagtggtatgacgcccatgacatgagcatctaccgcagcgctctgagctgctgtgtggtgccagggctggccaacgtcggggaatatgcagctagacgggacaacttcacaggattagcactgcgagatgaagtaaagtactccgcttcgacaag

SEQ ID NO: 11526 - DNA, 364 bp, Canis familiaris
  misc_feature (223)..(223): n is a, c, g, or t
aggcggagccacacaccctgaggagcggcgagctttagaaaactaatatggaaggaatggtcagttatcttgcttgttggtgcttgctcaggagctaagcagtgaaaatcctttcatccttgtatactaagaatgtctttgtgcaggatctacaggataaatctctaaaaattggattgctgggtcaaaggaaaagcatacttaaaattgtaaaatgcgtttncaaattcccattcaaaagactattctaatccacactgctaccagccatttttctacccccttaccaacagtgaattctacgaatctctaactttggttgacctgatagataaaaaaatggtgtctctttatcttgattttg

SEQ ID NO: 11527 - DNA, 546 bp, Canis familiaris
  misc_feature (29)..(29): n is a, c, g, or t
  misc_feature (78)..(78): n is a, c, g, or t
  misc_feature (97)..(98): n is a, c, g, or t
  misc_feature (103)..(103): n is a, c, g, or t
  misc_feature (118)..(118): n is a, c, g, or t
  misc_feature (310)..(310): n is a, c, g, or t
  misc_feature (425)..(425): n is a, c, g, or t
  misc_feature (493)..(493): n is a, c, g, or t
  misc_feature (510)..(510): n is a, c, g, or t
caagccatccgtgcttcatgtggatgccngtctgctggagaagattttcggaccaagcagagccctcgtcccggggtncgaacgggagttcaaggtnntgctncagatgagagagccnaactccgagggcaaggttgagatcctcatcatggggaggcgccggtaccggaagcgtgccaaaaggctgattcgcatcttggcggcgaagccccgagggaaacgctatggaggcacaatgatgttcagcctagaaaccatgaagtcttttgaaagagaaaatgttcattctgatgatttcctctccaccgcnatgatgagtagcctggatgaagccatgcagtccctggaaataggtcaggagactgtccaggaacctgttaccaaaacagtgtaatttttgtgattaggaacccagtgcagggggnacggtttgggtcaggagccttaccctcagaggcccggtctgaactctgcctttgttcctgtggctaangagaaacaagtattgtnggtggtctatccaccttcctccttcatagatagttg

SEQ ID NO: 11528 - DNA, 170 bp, Canis familiaris
gttttaggccaatgggatgccacctatggaaatccaaatcttccaggagaaactactgcactaaacacaacaggaacctcaaagtcaagatccatgagaatatctgttacacaactttccctacccagtttagcaaaacacctgtttcgggcaacaatacatctcaaaag

SEQ ID NO: 11529 - DNA, 129 bp, Canis familiaris
ggaaaatgctatacaggagtcctttgtggtttggggtggaatccaactacaggggctcctatactgccagagcacgacatcgagctagcgtttgacgttcagttcaacgtggaggatattgtagagatt

SEQ ID NO: 11530 - DNA, 233 bp, Canis familiaris
  misc_feature (97)..(97): n is a, c, g, or t
ccaggcctagggtgagaagtctcaattctgaaagcctgagaggacaggagaatccctgggattgtttcgatttcatcatatttatgatccatatccntgctaagaactacttttggccaaacgtgaacttgtacgattgattttctactcagatgcttcgaattccagagatccagtgatcctcgtagctcctttgggatattcagtatgggaggaacccatgatttccagag

SEQ ID NO: 11531 - DNA, 123 bp, Canis familiaris
atgaagtgctatataatgaatgaaatttaaatagtgatgaaggaagtttaaatagtataatttaaagcattttcctcttattgtttaaatgatcatctccatggttgtagctactgaggtttt

SEQ ID NO: 11532 - DNA, 377 bp, Canis familiaris
  misc_feature (26)..(27): n is a, c, g, or t
  misc_feature (71)..(71): n is a, c, g, or t
  misc_feature (351)..(351): n is a, c, g, or t
tattccagaaaaaagcactctccagnnaagctcattataccagttaaagcttaaggaaaaagataattctntaagaattatatctgcagttattgaaagcatgaagtactggcgtgaacatgcacagaaaactgtacttctttttgaaatattggctgttctcgattcagccgttacacctggtccatattattcgaagaatttccttatgcgagatgggaaaaatactctgtcttgtgtattttatgaaatagatcgcgaacttccaagactgattagaggccgagttcataggtgtgttggaaactatgaccagaaaaagaatattttcaaatgtgtttctgtcagacnagcgtctgtttctgaacaaaaatctt

SEQ ID NO: 11533 - DNA, 318 bp, Canis familiaris
tcatggcagaagtttgtagggcaattaaacaactggattatgaatggaaggttgtaaacccttattatttgcgtgttcgaaggaagaatcctgtgacaagcacctactccaaaatgagtctacagttataccaagtggatagtagaacgtacttactggatttccgtagtatcgatgatgaaattactgaagccaaatcagggactgctactccacagagatcgggatcagttagcaactatcgatcttgccaaaggaatgattcagatgctgaggctcaaggaaaatcctcagaagcttctcttacctcatctgtga

SEQ ID NO: 11534 - DNA, 77 bp, Canis familiaris
agaaaagccttcacaaatttgaagaagtgagtcctcaaaccaacgcatcttcctagaagcaatggaaacccttccaa

SEQ ID NO: 11535 - DNA, 248 bp, Canis familiaris
ctgagacttggtggctgtttgtccagcagtcagcatggatcaccgaagccgacctcggggcataggcctgaaccgaatccccgggactcgaacctgtcgaaccccactccccttccatgtggaacaacaggaagcccgggaaggagaagaattcgaacaacgggaagtacctcgtcagagaactcctgtctacgtgcccccggaaagtgaagagctgacagacaatgttatggtttccaagccagcgc

SEQ ID NO: 11536 - DNA, 226 bp, Canis familiaris
agggttctagggtgcctctaagttgaattttgttcccctcatcttcaaatattgttatgattcttgaattgactggttttgaacctaagttaaccatccttttcggatgctgacaaaagagtcttgtataccatcttttcacaatccctgtttctgactcttaagaaaactaggccgccctttgaaccatttgatgaatttgaatgtctgttatttatttccaacc

SEQ ID NO: 11537 - DNA, 331 bp, Canis familiaris
  misc_feature (56)..(57): n is a, c, g, or t
  misc_feature (59)..(60): n is a, c, g, or t
  misc_feature (66)..(66): n is a, c, g, or t
  misc_feature (68)..(70): n is a, c, g, or t
  misc_feature (72)..(73): n is a, c, g, or t
  misc_feature (75)..(76): n is a, c, g, or t
ccggcagcgggtactgttacttgtggacgccttttatttacatcgagttttttagnntnnacacanannngnncnntgatcctaagagcctccccaaagtccagcacagaggatacaattaaatacagcaactatattgaggaagagtctgaaacagacggggcagaatgtacaaggaaaacgagagcaattcctacaaaaggcctaacttgggtagaatgtgaaaacctgcatcaatccattgtggaggctctaggcgtgaaaggtgaaacgaagtgggatcacttgcatcaaggaatgttcaaactgagccaggaggactataaagctg

SEQ ID NO: 11538 - DNA, 73 bp, Canis familiaris
gccatggcaggaattctagatcatgtgacacaacctgtgcctatgtccagcctcacaattaaacctaaataga

SEQ ID NO: 11539 - DNA, 287 bp, Canis familiaris
  misc_feature (37)..(37): n is a, c, g, or t
  misc_feature (85)..(85): n is a, c, g, or t
  misc_feature (128)..(128): n is a, c, g, or t
  misc_feature (199)..(199): n is a, c, g, or t
aatggcaaatgatcctaattacttgcacagaatgccnctttattctgcattaatgcgctgtctgaagcctgtgggcaggaaatcnccactaagcagatgttgcctatcgtgttgaaaatggcaggagnccaagtagcgaatgtccgtttcaatgtggccaaatctcttcagaaaattggaccaattctagatactgatnctctgcaggaggaagtgaagccagtgctacagaagttaggtcaagatgaggacatggatgtcaaatactttgcacaggaagccataag

SEQ ID NO: 11540 - DNA, 271 bp, Canis familiaris
atctcggagttcgacgccaaagtcagcgagctgcaggcccagcttgaaagactgagaaacaagatcatccaggctaccttcagcacctccgggggcaagtcctttgccactgagatctcggacaacgacattctagaagccttgcagaggatcattacagaaagagccgactactataatcagctgaaacagaaaggtgtccgagtgcctccgctgcagcaggccgaggctttatcttcctcaagcaagtccaagaagctaccctccaagt

SEQ ID NO: 11541 - DNA, 348 bp, Canis familiaris
  misc_feature (284)..(284): n is a, c, g, or t
ccggatgacagatacccaggaccaaggggccagaatgagctctatgaaagtcttcattcaaacatggcagcattgtaagcaaggatttaagaagtgcagcttaattgtcgaagcaagcagtcttgtcaacacaaatacacactttgaagttggcaccatcattagaaacaacctgtgcggcaacggtgcccagaatcaacatgcaagaagcagcggaagccccctgacatttggcagtttaaggaggtttgctcatggggtttgtgttaggatgaggacggccntgtgcacgtccacctcggcagaacgcagcaggtcccaacttcttagctggatggtggctccgaa

SEQ ID NO: 11542 - DNA, 356 bp, Canis familiaris
  misc_feature (83)..(83): n is a, c, g, or t
  misc_feature (108)..(108): n is a, c, g, or t
  misc_feature (114)..(114): n is a, c, g, or t
  misc_feature (117)..(117): n is a, c, g, or t
  misc_feature (211)..(211): n is a, c, g, or t
  misc_feature (244)..(244): n is a, c, g, or t
  misc_feature (314)..(314): n is a, c, g, or t
agtccctaatgcagatgccatggccccctgaagaagaagaaacgataagaacgtgtgtggaatccaatccaaaggttggcganttaggcctcctatcccattagaggncagttnttnaaactaaaaactgagaactgctcgaaggcaaaaaacaaaactgaagcggcttcagacagtgcagccaagctagtcctggggggccgggctgccnccccgaggtcccagaggaaggggcaagtggccncccgcagcctcaggtgacaatccaggagcaaaggcctctggcccaaggcccagggcgcacggccctgggntccgtgttacaaagggcttgcacacttcactcatcttgactg

SEQ ID NO: 11543 - DNA, 273 bp, Canis familiaris
tcctgcaacatctgttctgcaatgtggaatgacctgtgaaaacactgtcacatatcagttctaggtaggactgctgggaaccccccacctcacagatgaagacaccgcagtctgacgagaatcaactatagtacatcacaggggccgaaacacaccctctccggatccaatacacacctgagaagcaaaccaccccacacttcacagtaactcagtccgcagtgaggcttgctagcaagttctgacacagctgccagagacaagaacctcatg

SEQ ID NO: 11544 - DNA, 433 bp, Canis familiaris
  misc_feature (223)..(230): n is a, c, g, or t
ggacaaaacaactaccaacctgcaaggatgtttccacctgaacaactcaggagctttttcctctgcgccctcatctatcttgctcatatttcattatttggcgaaattgtactctcctactaggctatgagctcctcaagatttttcatttttaatttcccagtgacaaggacagtgcaaatagaatgttaaataaatatctggcatgtgggttttttagtgnnnnnnnnctgtctttggattgtgtccagttcatcatttttggtaatggtgtggatgaattttagaggtgacatgaggtcgaaaaacagaactacattggaagaatgtacttgaaaatgtattggtagcttggaacaaagggccaaattcaacaagatgatggaataagagaataaaatcctgtatttgggcctccagaataactacaaag

SEQ ID NO: 11545 - DNA, 317 bp, Canis familiaris
gactgagaacagcttccgtgaagaaaaaaacttttttgccacatgccatcaactcctgtatttttgcctgagatgagcacaacttctaaatccagagaaatctctccccagaggtctgcaaggtgaaacactttaactatcaatgtgcttgatgttttaccttcctctatagcaaaactcttcaaagatgatgcctgccataaaacacagcgggcactcagtatctggggaatgaatggatgtataggtctgtgaagatgaaaggcgggacagggaggctaagtgatgtagtagagtcttcttttactggtattcaa

SEQ ID NO: 11546 - DNA, 161 bp, Canis familiaris
agggctctcaggaacagaattgtgaaatggaccaccagcactatgccagggaattgctgatcaccccgcccagggcctggtgcagtggtccccaaactccacttctgggttggggctgaggctagacaggagccccattcacctggagacgccacaggcca

SEQ ID NO: 11547 - DNA, 40 bp, Canis familiaris
atacactttctatggcgttcaccaattgattttatttctt

SEQ ID NO: 11548 - DNA, 285 bp, Canis familiaris
gagctagacaatatttcccatcttttaaggaaaatatcaactgatatcaatgaaattaagggaatgaaagcagcaattttgacagtggaagcaaatctttttgatttaaatgttagagtgtcacagaatgaagcaaaaatttcatctctggaggataaaatgaatgaatgttcaacatcatctgaatgcaataaacaatttgaagatcttcaagaggaagtagattttgaatcacagtcaaggactcctgatgtaaaaatgatcagcttccttagaaacattgag

SEQ ID NO: 11549 - DNA, 118 bp, Canis familiaris
  misc_feature (83)..(83): n is a, c, g, or t
atgccaaggacgaggcgtactgagcatcggggcacccaggtcctcaggactcctgtgtccttggcagcccccagcacacaccntgtgtaccagagcatgtattaaagttcgacgttgc

SEQ ID NO: 11550 - DNA, 298 bp, Canis familiaris
tgtcccaggccctgcagactgtgcaggaggctgtggggcttccaaggcgtctgttccccagaccaccagcagtaataatcaaatcacaaagacccaggccacagtctccactgagtcctatcccagcctcaagtgctatgaccagtgtaaagcgtgtatcaactacaatcccccgccaccgtgctactatgatataaacgagggactctgacttgggtggacacaaatatcttcatgtgcagtatttcttttccagtagaatttattattgaagtcagggtcaagtagtgtttacatc

SEQ ID NO: 11551 - DNA, 230 bp, Canis familiaris
cacattacgaggatgcagacttgagggcccggacaaaaatagtttattccacatatagtcgaaaatctgcaaaagaagtgagagataaattgttggagttacatgtgaattactatgttttagaagaggcgtggtgtgttgtgagaactaagcctggttgcagtatgctggaaatttgggatgtagaagacccttccaatacagcgaaccctcccttatgtagcatcttg

SEQ ID NO: 11552 - DNA, 453 bp, Canis familiaris
  misc_feature (28)..(28): n is a, c, g, or t
  misc_feature (42)..(43): n is a, c, g, or t
  misc_feature (50)..(50): n is a, c, g, or t
  misc_feature (55)..(58): n is a, c, g, or t
  misc_feature (97)..(97): n is a, c, g, or t
gatccaatggatcaaatccaattccagnccagatgctgtttnngcaggtnccatnnnnacgatggccagcgtcaagctgtctacccttcaccccatngtgaatcacccacattacgaggatgcagacttgagggcccggacaaaaatagtttattccacatatagtcgaaaatctgcaaaagaagtgagagataaattgttggagttacatgtgaattactatgttttagaagaggcgtggtgtgttgtgagaactaagcctggttgcagtatgctggaaatttgggatgtagaagacccttccaatacagcgaaccctcccttatgtagcatcttgctcaaagatgcgaggccttacttcaccacagtatttcagaatagtatgtacagagtattaaaggttaactgagaacgagacaacccatcacactctgatgcaaacaagtgtgtaga

SEQ ID NO: 11553 - DNA, 59 bp, Canis familiaris
tttcacccttacatctcactgcccttcagcatataccatgatcacgaggcaggggctta

SEQ ID NO: 11554 - DNA, 407 bp, Canis familiaris
tgacgccttcactccctggaatgtgcagggaggtgctcatgaagacgtttgcaggttttccaggcattgctcccaaaatagaattttctacaaggacagccatcagagaatgtgtgtttctgcaaagaaacagatttcctgaagacagacataagtcaaggaggcctttatctacaacacagggcccaaaactccccttaaataatgcgaagatgaagccaaaggagaataatctcaacagactgccccaaaacacgcaatcccgtgcaccttctccctgttccaccaggcgcatctttcaggaccagccagctcaacagaaccctggaaataacctcagaatctctgggggaagcaagcctccatttgtagttagacatgtggacagtgccaagccttttggtgag

SEQ ID NO: 11555 - DNA, 195 bp, Canis familiaris
cagagatatttttaagctgctgtcttatgggaatctgaaggaaagctggaggaacatcttgaagatctctctcaaggagccaacccccacatccttagagaaatgaacaaccatttttgttatgtgtatcaaatcaccagggtctcacccctttcaaatcaaaccctgtactcagtcttttgtggccaggtaaga

SEQ ID NO: 11556 - DNA, 371 bp, Canis familiaris
aacgccatctctgttttgtcggctagggttcacagcactaatggacaggtgcagcctgagctgcaagtcggaacgtgacatggacaaactggcccgcatcttcagctgttacattagtgacatcgtggagcgtgagtgaccactgtagggaagccaggaggcgtggtgccgggcttccccgagcgagcgagcgtctgtaacaacaggaggaggcctgggctacttgaaaagatactaaagggttacgccttcagtgttactcatcttttgtttcttttatttcttcttactgctaccaacaggctaggtttttgtttttgttttgtttgcctgtatctgccattctatctggtctcacatcctgaagtgga

SEQ ID NO: 11557 - DNA, 362 bp, Canis familiaris
  misc_feature (202)..(202): n is a, c, g, or t
aaagttggcctttcttggagaactgatgttttcagtggctgcataaagagttgttctataatggacataactcttttggacgaatatgggaaacccttttggtgtctcagttcccctgtttgcatgagatcttctgtgccctctgatggccctaacttcttgggacagacttactgtgttgactatgtggactcggaaggcnaaagtgcacgtggagctggtgtggatcaaagagacagaagaatacttcatcgtgagcctggtcctttacctgaagatagcaaaaataaaccactggtttgggacagcatactaagtattgcctgggggtggcaaaatattgctgctgtttgtttattttg

SEQ ID NO: 11558 - DNA, 473 bp, Canis familiaris
  misc_feature (362)..(362): n is a, c, g, or t
tggctaccagctgcatgttgatatgcacagcggtggagttttctacctgtgtggtacatttcgcaatctctttaccaagaaaggatccattgaaaatggatatgtgaagcttgttgttatacgttttaaaaataacacagaacacctacctcttattggaaaagttggcctttcttggagaactgatgttttcagtggctgcataaagagttgttctataatggacataactcttttggacgaatatgggaaacccttttggtgtctcagttcccctgtttgcatgagatcttctgtgccctctgatggccctaacttcttgggacagacttactgtgttgactatgtggactcggaaggcnaaagtgcacgtggagctggtgtggatcaaagagacagaagaatacttcatcgtgagcctggtcctttacctgaagatagcaaaaataaaccactggtttgggacagcatac

SEQ ID NO: 11559 - DNA, 469 bp, Canis familiaris
  misc_feature (83)..(83): n is a, c, g, or t
taaggactcctaacgctctgcggacactgcccggcgaatactgtctcgtctccgcagtgtgatgttgacataaatcctaaagnccaacagcacttgggctccgaacagcaactgctcagcgagcactcaggaagacttgcaaatgtttgaggaaaaaagagggaaatcccagcacattatccagtcacctgttaaggcccttttcagcaatggtagtgaatgccagaaggacctacacaacagggtacagggaaggccatcctagagactccacacagctcccccacatcaggagcctccgtaaagcttaggaaacagaaagagaggctaaatgcagcagcaacatgaaaatagtttaaaatgaacaatgtgcacacctaggaccaatccagatgctccacacattcacgtaagtgtacatgtgaatgatgaagagggcattggagttcttgcaagctggaaaccccat

SEQ ID NO: 11560 - DNA, 307 bp, Canis familiaris
  misc_feature (26)..(26): n is a, c, g, or t
  misc_feature (193)..(195): n is a, c, g, or t
gcagcccgggctaccacagaatccgnagaagccggggccgcgtggaccagtcagcaggagcgcttcaggaggaagggcccccgtgagttggttagctcagtctctcctggtgtccgaggagctgcccccggtctatgaacaatctacgtgggacgcggaagagttaggcccctttctacgcttgtgcctcatnnntcagaatttccccgcatttgtggaagaggtggaaaaggaactcagaaagctgacagggttgagaaattaacactccatgtacatacagaactaaggaatttgaaagcactga

SEQ ID NO: 11561 - DNA, 226 bp, Canis familiaris
  misc_feature (67)..(67): n is a, c, g, or t
aatgcttggcgcttcaagcgagtgctcaaggggctggtggacaagggcattctcaagcaggtgactngcaagggggcctcaggctccttccgcatgggcaagaagtttgcctccaagttcaagttcaggacccagagacagcgccagtctgggcagcgccggtctgggcagcgccggcctgggcagcaccggcctgggcagcgcaggttgctagcgggctcccaaa

SEQ ID NO: 11562 - DNA, 97 bp, Canis familiaris
ccaccgcaattaacagggcaggccaggcaaggaggaggcagggtgccaggcccgccacaggctcagtgcggtgagaataaaaggagcctaacttatc

SEQ ID NO: 11563 - DNA, 351 bp, Canis familiaris
  misc_feature (30)..(30): n is a, c, g, or t
  misc_feature (190)..(190): n is a, c, g, or t
  misc_feature (297)..(297): n is a, c, g, or t
  misc_feature (326)..(326): n is a, c, g, or t
tccgactatcctcagcgtctttactcttcntggcaccagctgccccctttcagtgtctcaggtaccaagaggctgttgccaagctccacctgccccaggtgacaaggaaacctctgggcacgtcccggccttgtactcatgcaggacttggggagtgcaggctctgggtcagttctgttcagggcctgangtcgccaccaccccccatcccggtgctgccagaaaggccctgctcccttgtctccacaccatgagagtggcctcaccttgctgccccagccagggaagtgggcaaanggcaggggccctgcacctcagagcttgtncctggtggcatgtgactgtcaataa

SEQ ID NO: 11564 - DNA, 440 bp, Canis familiaris
  misc_feature (50)..(50): n is a, c, g, or t
  misc_feature (54)..(54): n is a, c, g, or t
  misc_feature (57)..(57): n is a, c, g, or t
  misc_feature (62)..(62): n is a, c, g, or t
  misc_feature (64)..(64): n is a, c, g, or t
aactgagcagctgcaacatggcaaaagtggcggagaaatcatgggcgccncganccnaggancnccaagcggtggaagaagaggaagagcccctctcggtccagatcaaggggcgctaaaaaggtgctaaagatctacaagaaggtaaaaagatcacttcatgcaaattcaagaaagaaacactctcctaaagtcacgaccacttcaagaagaaagaagagagcaagaagggccagcaagtttcagccattgctgtagactaagagccacaagcagccaggcccagacccagtggaccctgcaagctacaccactcccagacaagaccatgcagcagtacctacagagcaggcttcagagacctcggacagtcttcatctagagacctggctgcggagaaatggccaactgcgtagagaccgactcagaccttaatgtgg

SEQ ID NO: 11565 - DNA, 210 bp, Canis familiaris
  misc_feature (73)..(73): n is a, c, g, or t
tggatgggagcccagaccaatctctctcaggctcaacaggtgactctttgctacttctatgttaaaccaaacncaacaaagcaagttccgtcttcagaatggagatggaagaatgactggaagccggaccctgatcccagcagtagaagacggaaggcgggaagtgtgcccttgcaggaagagggggctggcccaagaaggactctctag

SEQ ID NO: 11566 - DNA, 219 bp, Canis familiaris
  misc_feature (57)..(57): n is a, c, g, or t
  misc_feature (93)..(93): n is a, c, g, or t
  misc_feature (96)..(96): n is a, c, g, or t
ttctgcctccttcaagagggagggtgagggcaagtatcggacggagtgcaaactggncacccggccaggctcgcgggccgagcaccgggccgnccncaagctgggagccaaaacccagccccggctgttggtggtgcccgagaacgaggacaggatggaggacaggctggccgagacctccaaggccaaagatcatcacgtcaccggagccgaggtggg

SEQ ID NO: 11567 - DNA, 88 bp, Canis familiaris
gcggtgcatggtgtgcgcccacataaactaaatagacaggtaggagctgcagaaggcacaggtgcaaggaacaagtaaaatccgtcaa

SEQ ID NO: 11568 - DNA, 521 bp, Canis familiaris
gaatgcatcatatatccatgttcagagagatgttatcaggactgtctcactgagtgcacctccccgcagcaggcccacaaatgggtcctacaataaagttgatgttaacaaggaacccaaactcaacctctgtccagataaatatatgtcaacatcatataatggttcagcctggcgaaaaagaattcctttttcaaaaacatattcaaaaactgaaaagatatatgcagagccaagaagaaatgggagcaagtaaatctggaggttgagagaagagaaaaatgagaaaagagaaaagtgccagatatcctctgatttacaatcaaaaatgaaaattcaaagaatgagatattcaagtactccatactatatactgggtagccaaagatgataaaatgcaaattctgaaaataagatgcaggaagtacattgtgctctttcaaaactgataaaaatgcaaattacaaacagctgcctgtgtatttatataggtctggaattcattcgatgcattgccacaa

SEQ ID NO: 11569 - DNA, 271 bp, Canis familiaris
  misc_feature (101)..(101): n is a, c, g, or t
  misc_feature (120)..(120): n is a, c, g, or t
aaagctgggagtcggaattcaaaatcccccatccccaagggcacgaatggtgctgcttccccagccaagaaggaaaaccgtgtccctaaagaagtcattgnccatgcggccaaggagggncctaaaagccaaggctgctgctcctccgaatggtggcaggtctaagatgctgcctgaacacctggccaggaagacagaggcccccaggggccctaggaggactggcatgcccaccaagtcctcctcatccaaactggccagtaggaaggca

SEQ ID NO: 11570 - DNA, 460 bp, Canis familiaris
  misc_feature (58)..(58): n is a, c, g, or t
  misc_feature (85)..(85): n is a, c, g, or t
  misc_feature (89)..(89): n is a, c, g, or t
  misc_feature (199)..(199): n is a, c, g, or t
  misc_feature (218)..(218): n is a, c, g, or t
aggccctcccaatccagccaaggtgaaagggggcccaggaagccaggagaggcgaggnctgctcctcccaaaccaggtggtgagncccncaggaaaacaaagctgggagtcggaattcaaaatcccccatccccaagggcacgaatggtgctgcttccccagccaagaaggaaaaccgtgtccctaaagaagtcattgnccatgcggccaaggagggncctaaaagccaaggctgctgctcctccgaatggtggcaggtctaagatgctgcctgaacacctggccaggaagacagaggcccccaggggccctaggaggactggcatgcccaccaagtcctcctcatccaaactggccagtaggaaggcagagactgagagctagagctggggtggagacactgaggttctgcctgagtttttattccccaacaaactgtcactctatttatttcattgta

SEQ ID NO: 11571 - DNA, 70 bp, Canis familiaris
tctacaccaacgtcagtaggcacttcaagtggatcaggacgctcatggcccgcaacagcattcagaggcc

SEQ ID NO: 11572 - DNA, 400 bp, Canis familiaris
ccggcggcctggtcaacttgcaggacggctccctggaggccgggctgaggcgcgagctgagcgaggagctgggcgaggcggcggcccccgtgcccctggagcgcgccgtgtaccgcagctcgcacgccgcgcccgggccgcgggtggtcgcccacttctacgccaagcagctgacgctcgagcagctgctggcggtggagaagggcgccccgcgcgccaaggaccacgggctggaggtgctaggcctggtacgggtgcccctgtataccctgcgggatggtgtgggaggcctgcctgccttcctggaaaattcctttattggagctgcaaaggagcagctgctggaagcccttcaggatttagaactggtggaacctggttctcttacagcccataagat

SEQ ID NO: 11573 - DNA, 145 bp, Canis familiaris
gggtcagacaccgtgggagtcatcataggtgggccggctgggagcttctgtggaagctctggaactttccccagctgagtggagagcccaacccccttcatgtgcaattgccttgaactgtgacctgcagagagctctctcgtgg

SEQ ID NO: 11574 - DNA, 544 bp, Canis familiaris
  misc_feature (154)..(154): n is a, c, g, or t
  misc_feature (173)..(173): n is a, c, g, or t
  misc_feature (197)..(198): n is a, c, g, or t
  misc_feature (200)..(200): n is a, c, g, or t
  misc_feature (202)..(204): n is a, c, g, or t
  misc_feature (395)..(395): n is a, c, g, or t
  misc_feature (487)..(487): n is a, c, g, or t
tacgcgtacctgtctatggcctattacttctcccgagaggacgtggcgctcaacaacttcgccaggtacttccttcgccaggcccgggaggaggcccagcacgccgagaagctgatgcgcctgcagaaccagcgggggggccggatctgcctgngggacgtcaagaaaccggnccgggacgactgggagagcggccnnangnnnatggagtgtgcgctgctcttggaaaagaatgtgaaccagtcgttgctcgaattgcacactctggcctcagaccaaggcgacccccatttgtgcgacttcctggagacgcactatctgaatgagcaggtgaagtctatcaaagaactgggtgatcacgtgcaaaacctggttaagatgggggccccggattncggcctggccgagtacctctttgacaagcacagccttggaaacgaaaacaatcagaactaagccacaggctgccctcctcgctgcccagggngggccaagacccagagtctgcagactcctgcttccttgcccttaaaatgaacctcta

SEQ ID NO: 11575 - DNA, 397 bp, Canis familiaris
gacaaccatccagagttttcaaagggtccagggatttaagaagatggttgacaggtggcgaaattcacatactcgctgtatgtggcagatgacactgagccagaggagaaacctgtatgctaccctaaggatgcaggacaccatgggacaggagttggcactagccaacaagcagctactgatggtccgtcaagcggccctgcaccagctgtttgcaaaggagcatcggcagtacaagcaggagctaagtcagatgggcaaagcattttatgtggagagactctgatggcagctgagacaaagctggctctcaaaggctcgactgtagacatacgctcgttcttcagccctaaatcttcattgtttggacaatgtttattcatagctgtaaccttaa

SEQ ID NO: 11576 - DNA, 297 bp, Canis familiaris
agagcttgccaagtaaaaggactttttaagattttttataagtcggtgtattaaaccttgggagttgaaggcgggggaggggaggtaacagctgatacttgaacaatgatgatgacaagggttcaaaagaatgactctggtgacttagcaaagatgtaagaaaagaagagtagacgggtccatgatgggaattgtgagattctcaaaagacaatgtaatgatgtcgattggcaaggttgttgtgggtttatagcaggagtgccaacatgatagataatgtggctttaatgagggaaa

SEQ ID NO: 11577 - DNA, 80 bp, Canis familiaris
gatgattttgtaaaccgtaggagcccatgacttagtggaaatccgtactccagccaggcagctcttccagtgtttctctc

SEQ ID NO: 11578 - DNA, 564 bp, Canis familiaris
gacagtgggtcattctgccaggaatcccttctgatgattaaatcaggggccaagacagccattttggccactaagggctgcatctcggaggggacacaggcgataacatacatccagcactccccaccgccaggcatcatcacagtctcctacagcagctactgtgaggagtccttatgcaatagcaaggagaacttactgcaactgtggagggaggaagagccccaagctgccagcacgtcagcacacctctactgcccaacctgtgtggctctgggggcctgttcaaatgctccttctcttccctgtcccaatgatacagttcagtgctatcaaggaagacttcagatcactggaggaggcatcaactcccttttggaggtcaaaggctgcacttctataactggttgcaggctgatgtccgggatctttacagtagggcccatatgggtggaggaagtctgtccataccggtctgtacttcaaccccgaaagattgaaaaccgggctgcctggcttcctgtttacatttggagattagagctagcgctgctgctattacta

SEQ ID NO: 11579 - DNA, 468 bp, Canis familiaris
gatcttcagccagatgtaaaccagaatgcacaaaagatcaatgaacttgaagctgctcttcagaagaaagatgaagatatgaaagcaatggaggaaagatataaaatgtacttggaaaaagcaagaaatgtaataaaaactttagatcccaaattaaatccagcatcagctgaaataatgctacttagaaagcagttggcagagaaagatagaagaattgagattctggagagtgaatgtaaagtagcaaaattccgtgattatgaagaaaaactcattgtttctgcctggtacaataagagtctagcattccagaaactggggatggaatctagacttgtgagcggcagtggtgcatgcaaagacactggtgcctgtactcctgcacggtctttcttagcacagcaacggcatatcaccaacaccagaagaaatctctctgttaaagttcctgctataacacctgat

SEQ ID NO: 11580 - DNA, 176 bp, Canis familiaris
ggcacttctggccagaaactcttgctgcatttacaggctattcattaaatgaaattgtgccttgcctgagtgagttacataaagcatgccttgatataccccatcgacctcagcaagcaattagggagaagtataaggcttcaaagtacatgcacgtgtctctcatggaaccacct

SEQ ID NO: 11581 - DNA, 402 bp, Canis familiaris
ctggctgtcaacttcctggataggtttctttcttgcatgtctgttctgagagggaaattgcagcttgtaggaacagcagctattcttctggcttcgaaatatgaagaaatatatccacctgaagtagatgagtttgtctatataactgatgacacttacacgaaacgacaactgttaagaatggaacacctgctcctgaaagtcctagcttttgatctgacagtgccaaccaccaaccagtttctccttcagtacttaaggagacaaggagtgtgcatcagaactgagaatctggccaagtatgtagcagaactgagtctgttggaagctgacccattcttgaaatatctcccttcactgagagctgcagcagcttattgcctggcgaactatactgtgaac

SEQ ID NO: 11582 - DNA, 562 bp, Canis familiaris
  misc_feature (61)..(61): n is a, c, g, or t
  misc_feature (426)..(426): n is a, c, g, or t
gcttgggcattctgctaacagggcaccatttgttccttcaccactttcctctgtggcggcnaccctcggcagccccgagcatgcctggctgccaccaccagcttttccaagatctctgaggcctaccagcatgagccaggtcccacagttgcaggatgagatgcgccggcagctgccactgctgctgcaccttcaggcagccatggctaaccctcgtgccatgcatgccctgctacagattgagcagggtctgcaggtcctggctactgaagccccgcgcctcctcctctggttcatgccttgcctagcagggctgggaaatatggcaggcagtacagagcctagggagggctctgtgcagcccacctgggctgttcttcagcttctctatgcactagccaaagcctgttctcagtccacacaatnctcactatcctcattctccctccctgaaggctgcttccagcaagaactggagcatctgaaggccatgggttttgctaaccatgatgccaatctacagaccctcatggcagcgggaggagacattcaggttgccatt

SEQ ID NO: 11583 - DNA, 454 bp, Canis familiaris
  misc_feature (41)..(41): n is a, c, g, or t
  misc_feature (50)..(50): n is a, c, g, or t
  misc_feature (76)..(76): n is a, c, g, or t
  misc_feature (116)..(116): n is a, c, g, or t
  misc_feature (138)..(138): n is a, c, g, or t
  misc_feature (366)..(366): n is a, c, g, or t
  misc_feature (412)..(412): n is a, c, g, or t
gaaaggtgctccgaactcagactgtcaaaaaaacctggganctgtgggtnccgttgccttggactgcaaaggaaancgtggcctatgcaacctcgacgggtggcatcgttaataanatggttggccgtgttggggacnccccatgcataggatctggcggttatgctgacaatgacattggcgccatttcaacaacggggcacggggagagcatcctgaaggtgaatctggccagactcactctcttccaggtagaacaaggaaagaccctggaagaggcagccgacatgtcattgggttatatgaagtcaaagctgaagggtttaggtggtgtcatcttggtcagcaaagcaggagactgggcgntgaggtggacctccgcctccatgccctgggcggccgccaaggatgncaagctgcactccggaatcgatcttgaggagaccagtgtcac

SEQ ID NO: 11584 - DNA, 546 bp, Canis familiaris
ctgttcttatcaatgcactgggcactttcgattccttccttccaggctctagggcaagaaaatagcatatcattggtgaaagcttattggaatgaactttttactcttggtcttgcccagtgctggcaagtgatgaatgtggcaactatattagcaacatttgtcaattgtcttcacagtagccttcaacaggaaagaagaaaattattgatggagcacatctttaagctacaggagttctgtaacagcatggttaaactctgcattgatggatatgaatatgcctacctgaaggcaatagtactcttcagtccagatcatccaggtctagagaacatggaacaaatagaaaaatttcaagaaaaggcatatgtggaattccaagattatataaccaaaacatatcctgatgacacctacaggttatccagattactactcagattgccagcattgagactgatgaatgctaccatcactgaagaattgtttttcaaaggtctcatcggcaacgtacgaattgacagtgtcatcccacatatttta

SEQ ID NO: 11585 - DNA, 85 bp, Canis familiaris
gaaaattgtatcctagatgctagcttggaaggaaagtccagtttcctggtatggagacttggcttaatcaattagatctagaagt

SEQ ID NO: 11586 - DNA, 580 bp, Canis familiaris
ttgcttccttctgagtctgtcaaatcagagagtgaggacctaaactctctcttcttaaaagtggatagcctgagaatcaaaattttaggaacttctgtgccaatagaaaagtttgttgctgagaagggccagcgctatggcactactacaggctggtttactgcacagcccatcctggaattcatttatgcctggagtggtttccgagtcatgagtaaaaaactagaccttatttcaagctggttatcaataattaatagaggagaagaccttttacgagaaaatccaaataaagagtatggcacagatgacataagtttgttaaatttactgaaaggtctatgcctgaaacatttaggcagatattcgacagctgagcattactttaatcgtgtcattcaaaaggagaagttgttaaaatatgaccactatttggtgccatacacttattacgaactaggaattcttcactacctaaaaggagattatgagagtgcaacaaaaaacctagacaacataaaaaactacaaagactattccatggaagcccgattacagtttaggactcacatagctcttg

SEQ ID NO: 11587 - DNA, 350 bp, Canis familiaris
  misc_feature (37)..(37): n is a, c, g, or t
  misc_feature (49)..(49): n is a, c, g, or t
  misc_feature (59)..(59): n is a, c, g, or t
  misc_feature (80)..(80): n is a, c, g, or t
aatgcaatccgtggccccgaatcatactgtcagagcncagcagcctcancgaacctccngtgcctggatgctgaaacacngtgcgcagcagccgtggcctgagcagcactgtgaacgtgagtgtcagcaagaggagaggctctcgcacgccacccaaaagtaccaacggcttgcctgtttcctgctctgaaaatcccttgagccgagcacgcagttttagcactggcacaagtgctggtggcagcagcagcagccaacagaactctccacagatgaagaactcccccagctttccttttcatggcagtcggcctacagggctgccaggtctgggctctagcactcaaaag

SEQ ID NO: 11588 - DNA, 442 bp, Canis familiaris
gaaaaatctacgtatgtgaccattgtaacacaaagcgtagaaggttttcttcaaaatcagttgtactcacagaagcacaaaaacagcttatgatttgccacctacctcaggttctcagactacatctcaaacgattcaggtggtcgggacgtaataaccgagagaaaattggtgttcatgttggctttgaagaaatcttaaacatggaaccttattgctgcagggaatccctgaaatccctcagaccagaatgttttatctatgatttatctgctgtagtaatgcaccatgggaaaggatttggctcaggacactacactgcctactgctataattctgaaggagggttctgggtacactgcaatgattccaagctaagcatgtgcactatggatgaagtatgcaaggcccaagcttatatcttgttttatacccagcgagt

SEQ ID NO: 11589 - DNA, 228 bp, Canis familiaris
  misc_feature (32)..(32): n is a, c, g, or t
  misc_feature (47)..(47): n is a, c, g, or t
  misc_feature (53)..(53): n is a, c, g, or t
  misc_feature (91)..(91): n is a, c, g, or t
atggaaaagtccttccgagaagaagagaagancttttggatgaagtnccgtancttttggaaggaggacaaggccttttggaaagaggacnccgccttatgggaaagagaccggaaccttcttcaggaggacaaggccttgtgggaggaggagaaggcattctgggtggaaggcggtggcccttttgctgaggggcaggtccctgacaacaggcccggtgtcgtcgac

SEQ ID NO: 11590 - DNA, 558 bp, Canis familiaris
  misc_feature (31)..(34): n is a, c, g, or t
  misc_feature (41)..(41): n is a, c, g, or t
  misc_feature (136)..(136): n is a, c, g, or t
  misc_feature (146)..(146): n is a, c, g, or t
  misc_feature (156)..(156): n is a, c, g, or t
  misc_feature (161)..(161): n is a, c, g, or t
  misc_feature (259)..(259): n is a, c, g, or t
  misc_feature (442)..(442): n is a, c, g, or t
tttcaaaccagatttcctctacagctctctnnnncaggtcnaaacaactgctgcaagtgcttccacccagtttttgcagtaatcatgagatactcttcattctctgggtgtagctggcaagagtacgccgccatgnccagggactngcaaaagcgnctgcncacgagtagaaacaaagctcccctctccacaggcgtcagcgggatgacactctcaaaccccgccaggacgtgacctcccacgtgcatgggactcttgntctcaatcatcatgtacatgatggtaatggccgcttcaaacacgtagtagccgtagctcatgtcatcgaagtctaaaatcccagacacttgatatgcagcatctccacaggctgacttactggactccactaggatgttatggtcattaagatccccatgattgagacctaaaagaagaaaanccaagccatgtgaaagcattgaattccccacttcattgtcttcccatttcctgtttcttgggcacagccactccgatgtgatgagcagtccgaggtagagccaaaccctatttgtc

SEQ ID NO: 11591 - DNA, 435 bp, Canis familiaris
  misc_feature (94)..(94): n is a, c, g, or t
gagaaaagagaagatcccggtgataactgggaagaaggtggaggtggcggtggtggtgtagaaaagtcttcaggtccctggaataaaacagctncagtacaagcacctcctgctgcagtaattgttacagaaaccccagaaccggcaatgactagtggtgtgtataggcctcctggagccaggttaaccacaacaaggaaaacaccacaaggaccaccagaaatctacagtgatacacagttcccatccctgcagtccactgccaagcatgtagaaagccggaaggataaagaaatggagaagagctttgaagtagtaagacacaaaactagaggtagggatgaggtttcaaaaaaccaggcccttaaacttcagctagacaaccagtatgctgtgcttgaaaatcagaaaagcagccacacacagtacaattaa

SEQ ID NO: 11592 - DNA, 351 bp, Canis familiaris
  misc_feature (162)..(162): n is a, c, g, or t
aggttgattacagcggcctccgagttcaggcgatgcaaataagtagtgaaaaggaagaagatgataatgagaaaagagaagatcccggtgataactgggaagaaggtggaggtggcggtggtggtgtagaaaagtcttcaggtccctggaataaaacagctncagtacaagcacctcctgctgcagtaattgttacagaaaccccagaaccggcaatgactagtggtgtgtataggcctcctggagccaggttaaccacaacaaggaaaacaccacaaggaccaccagaaatctacagtgatacacagttcccatccctgcagtccactgccaagcatgtagaaagccgga

SEQ ID NO: 11593 - DNA, 480 bp, Canis familiaris
gagaaagacgcagccgcacataggaggcaccggccaggccccggggcccctccaccaggggtggcccccggacacctcaaggcagccagcgagatagctgagctccagaggagccggagtgtgggtggcctgcatcagaagggggaccctccgagctgcatcaagaagccatccaaggagctggagtctgaggaccagggaagggacctacgaagtgacattgaagatgccagctgtcaggcagacccagaggaggacaagcaggaaaagaatcaggatgccctcgagaagttggaccctgatggaggaaggacggagccagaagggaagggctgccgcccagaggccagtggcaagagagcctcctctcctctccagcccaccctggaacgccatccacacctctctggtttccattcacagaaaccatctgagtttgtggagattgatctgggagaccgtgccgaggaggtagtcaca

SEQ ID NO: 11594 - DNA, 553 bp, Canis familiaris
  misc_feature (75)..(75): n is a, c, g, or t
  misc_feature (89)..(89): n is a, c, g, or t
  misc_feature (118)..(118): n is a, c, g, or t
  misc_feature (166)..(166): n is a, c, g, or t
  misc_feature (171)..(171): n is a, c, g, or t
  misc_feature (186)..(186): n is a, c, g, or t
  misc_feature (190)..(190): n is a, c, g, or t
  misc_feature (210)..(210): n is a, c, g, or t
  misc_feature (313)..(313): n is a, c, g, or t
  misc_feature (316)..(316): n is a, c, g, or t
  misc_feature (355)..(355): n is a, c, g, or t
aataccactctgcagcattcagctttctgagggactctggatgtgggggaggagaaagctacaactaaggaaaanccagaatcatctcncgctgacagcatagcctttccttggaaanccatttgggagcatggctccgggtaagaagcattattccagcatgtanctccnaggtccacgccaccnaccnatcacacctcgcctccgttnccaccgcagggtgagcatgagaagatgtgctctcagaagggctatggccaagagatggagagaaggaaggaaatgaacgtaggaccgaaggacaggtgggagngancaaagcggaatgaagaggaggtagagggaggaagtaagncaagaggggagatctcacggagaggtggtgacagaagaaaacagaacagccctgaaggagaagctgaggaggacaagagaagaaatagaccattgacagatgcctccctaagcttctatttatctaatttaaaacttgaaagtaaggccatatatcaaaacagttgtgttttcttctctgtgccaagtactctggata

SEQ ID NO: 11595 - DNA, 300 bp, Canis familiaris
  misc_feature (164)..(164): n is a, c, g, or t
agtcagttacaggttgaggctgcacgattaggtattttaccggtgggtcgaggaaagaccatgtcctctcaaggtcgaggaagaggcagaggccgtggaggaagaggaaggggctcactgaatcacatggtggtggaccaccgccccaaagcactaacagttgngggattcattgaggaggagaaagatgaattacttcaacatttctcaactgcaaaccaagggtcaaaattcaaagaccgtcggctacaaatatcatggcacaaggccaaggtgccttctgtatccactgagactgag

SEQ ID NO: 11596 - DNA, 355 bp, Canis familiaris
aacctcagatttgtttttgcatgatgatgatgatgaagatgaagatgaatatgaatctcgttcatggcgaagatgaaatctgatgcgagctgtatagtttttaggaatattgtttagaagaacaactttttaaaattatttaaagaagtcaatgagccaaaaattttttttatttttcttttccacacagtaggtttaaggacagcaagtttgctatttaaacacatctcataactgttcatgatattaaagcaccaaaggcctagtgacttttacacagttgtgaagatccacaggaatgatacggataatctctagagccttactttccacaccacctgttttgttgctattg

SEQ ID NO: 11597 - DNA, 133 bp, Canis familiaris
gttgattctctggaccctgaaaagctattacaatgcccctatgataaaaaccaccagatcagggcctgcaggtttccttatcatcttatcaagtgcagaaagaatcatcctgatgtcgcaaacaaattggcta

SEQ ID NO: 11598 - DNA, 219 bp, Canis familiaris
ccgtgaaggcccgagaccagaaggtggctggagacctggaggcagcccggcgattcggctccaaagccaagtgctacaacatcctggccacgatgtgggcgctggtgccgcctctgctgctgttggcgctggtggtgaccggggcgctgcacctgtcccggctggccaaggactctgcggccttctttagcaccaagttcgaggactcggactatgact

SEQ ID NO: 11599 - DNA, 521 bp, Canis familiaris
tcacaccccgtttcgagagagtaagctgacacaggtgctgagggactcctttatcggggagaactcaaggacctgcatgatcgccatgatctcaccaggcataagctcctgtgaatatactttaaacacactaagatatgcagacagggtcaaggagctgagcccccacagtgggtccagtggggagcagccagttcaaatggaaacagaagagatggaatccagctctcatgggtccctgatctcaggcaatgaagatgaggaactatcttcccagatgtccagctttaatgaagccatgtctcagatcagagaattggaggaaagggctatggaggagctcaaggagattatacaacaagggccaggctggcttgagctctccgagatgactgaacagccagactatgacctggagaccttcgtgaacaaggcagagtctgtcatgatccagcaagccaagcacttctcagccctgcaagatgtcatcaaggccttgcgtctggccatgcagctggaag

SEQ ID NO: 11600 - DNA, 286 bp, Canis familiaris
catttgggtatgaagctgtgctcctccaccgggtttaggggagggagccctttgggactgtgagacaaggaaagagggccagcagtgagagtatgaagcaaggaaagagaagtcccaggggagtgtgaggacagagcagagtccagatgccaagcttggaaggtgttagtggttatgagagtgcctctgctctttctacctgatccccgaagggccttcttctcttctcccaccctaatctgcttctcatatgcctcttcttacttcacccacgtttattattatg

SEQ ID NO: 11601 - DNA, 422 bp, Canis familiaris
  misc_feature (31)..(32): n is a, c, g, or t
  misc_feature (188)..(188): n is a, c, g, or t
  misc_feature (198)..(198): n is a, c, g, or t
  misc_feature (200)..(200): n is a, c, g, or t
  misc_feature (235)..(235): n is a, c, g, or t
  misc_feature (249)..(249): n is a, c, g, or t
  misc_feature (261)..(261): n is a, c, g, or t
  misc_feature (275)..(275): n is a, c, g, or t
  misc_feature (281)..(281): n is a, c, g, or t
  misc_feature (284)..(284): n is a, c, g, or t
  misc_feature (300)..(300): n is a, c, g, or t
  misc_feature (304)..(304): n is a, c, g, or t
  misc_feature (306)..(306): n is a, c, g, or t
  misc_feature (321)..(321): n is a, c, g, or t
  misc_feature (323)..(323): n is a, c, g, or t
  misc_feature (329)..(329): n is a, c, g, or t
  misc_feature (340)..(340): n is a, c, g, or t
  misc_feature (342)..(342): n is a, c, g, or t
  misc_feature (382)..(382): n is a, c, g, or t
  misc_feature (395)..(395): n is a, c, g, or t
aggagatccccatccggagcatcagtctgannagctgctactttagcgacccagactggtccatgaggcccacgctgacagatctcctgcccaccttccggaacactctgcagaaactaacatttgagttcaataacaaccacgagtcgctggacgaggagctgcacctcctggtcttgtcctgtcgnaaagctgttntncttcaagatctgggcttttcttgacgtcaagtttntggagcggatcctnaagagtcaggangaagggcagtgctnccctgngcnctctcaaggtgagaantttncncaaaccgatacgagncnaaatgncgaggacaggncnctgcgcgagatccacaggaagtaccgaaagctcatcgatncggagctcaactncttcgtcatcgcgtaccccatgatgta

SEQ ID NO: 11602 - DNA, 153 bp, Canis familiaris
  misc_feature (47)..(47): n is a, c, g, or t
  misc_feature (67)..(67): n is a, c, g, or t
  misc_feature (121)..(121): n is a, c, g, or t
ccatgatgtagccagtgctctctgggagccccctcccggtccccggncccgccccgcccctttcctnctgcgggtctctgccgttcctcccctctgacgccagccccaacccaggccgggncgcgggcgatgggactttaaaggctatcttta

SEQ ID NO: 11603 - DNA, 338 bp, Canis familiaris
  misc_feature (35)..(35): n is a, c, g, or t
  misc_feature (41)..(41): n is a, c, g, or t
  misc_feature (58)..(58): n is a, c, g, or t
  misc_feature (64)..(64): n is a, c, g, or t
  misc_feature (91)..(91): n is a, c, g, or t
  misc_feature (100)..(100): n is a, c, g, or t
  misc_feature (132)..(132): n is a, c, g, or t
  misc_feature (158)..(158): n is a, c, g, or t
  misc_feature (218)..(218): n is a, c, g, or t
  misc_feature (301)..(301): n is a, c, g, or t
atcccatcgaacgagatattgagataggattcctnccatgnctaatgaatgaagttgncaaaanccatggaatacaatatggtgggaagancagtgcttnacatgttgattcgtgaggtggtcgagaagagnctggctatgtatgagcataaggaggnccagcctccatttgtgcagtctgaggatgggttcagtggccccagagcaatgagagaatnccctgatgggtgatgaattccatgaacaaagtgcatcacagtcacagagggtacttcaggccagagactccctgcaaagaacnccaagcaacagaaggtatatggagaatgtgtcatccc

SEQ ID NO: 11604 - DNA, 185 bp, Canis familiaris
aacagaaaggaatatctcagggagagaactattataactaaggggaactctcgagccacgaccactcagcggccaggcagcagtgccagcaatcaggtaacgatgtgtaggtcccctcagcccatggaaattatgttgtatttacccaacatgtttttttgtctaatggactgggcaaatcaaat

SEQ ID NO: 11605 - DNA, 178 bp, Canis familiaris
acaaaccaacagagagctgtgaagtttacaccattgttatcaggaatttatccaggagctgctctctcggataagaggcatgaggaaactgaaccctccgcagaagaagaccggataattctaacacagggtggaactctcccagagacgaagatgggtcctgggatttgggcttcat

SEQ ID NO: 11606 - DNA, 255 bp, Canis familiaris
ttagccggaatatgatcagaaagatccctgaatcaatctccaagttccagaacctgcggtggctggaccttcacagcaactacatcgacaagcttcctgaatccatcggccagatgaccaccctgctctacctcaatgtaagcaacaataggctgaccaccaacgggttgcctgtggagctcaatcagctcaagaatatccgtaccctgaacctaggcttgaaccatctggacagtgtgcccaccactctgggtg

SEQ ID NO: 11607 - DNA, 527 bp, Canis familiaris
tgaggcaagtcgcagagtcaagtctgaactactcattcagatggatggagttggaggagctttagagaatgatgatccttccaaaatggttatggtattggccgctactaatttcccatgggacattgatgaagctttgagaaggagattagaaaagaggatatatatacctctcccaacagcaaaaggaagaactgagctgctgaagattaatcttcgtgaagttgaactggatcctgacattcaactggaagatatagcagagaagatagagggctattctggtgctgatataactaatgtttgcagggatgcctctttaatggcaatgagacggcgaatcaatggcttaggtccagaagagatccgtgcactttctaaagaggaacttcagatgcctgttaccaaaggagactttgaattggctcttaagaaaattgctaagtctgtctctgctgcagacttggagaagtatgaaaaatggatggtcgaatttggatctgcttgaatttctgtcagctctttca

SEQ ID NO: 11608 - DNA, 545 bp, Canis familiaris
aacgcatgttatttcacggttctcctttcattaatgccattattcataaagggtttgatgagcgacatgcatatataggaggaatgtttggtgccgggatttattttgctgaaaattcctccaaaagcaaccaatatgtttatgggattggaggaggaacaggctgccccacacataaagatcggtcatgttacatatgtcacaggcaaatgcttttctgtagagtgacccttggaaaatcctttctgcaattcagcaccatgaaaatggctcatgcccctccaggacatcactcagtgattgggagaccaagtgtgaatgggctggcatatgctgaatatgtcatctacagaggggagcaggcatacccagagtatctcatcacataccagatcatgaagccagaagctccggcacaaaccgccacagctgccgagcagaagacctagtgaatgcccactggtaaaggccacattggatttcaacctgggactggattacagtggattgtttccaacaaaatcaatattccgtcaatccctgac

SEQ ID NO: 11609 - DNA, 155 bp, Canis familiaris
  misc_feature (120)..(120): n is a, c, g, or t
tgaaccaactgcaagtctctataatagtatgctttctgctaaactgtatgttgactgaaaaagaatctcatacccttgaagagttttacctaaaatttttaactactataatttttgtgncctctttgaagaggtatactactttaaacagcata

SEQ ID NO: 11610 - DNA, 123 bp, Canis familiaris
gtactacatgtgaaggacccatcataccacgttggcaccctcttcccaagtgaccactggcctgcccctgcctccaccggtgactgaactaccacctcaggtgactgttttttaaatgctggg

SEQ ID NO: 11611 - DNA, 415 bp, Canis familiaris
  misc_feature (191)..(191): n is a, c, g, or t
  misc_feature (223)..(223): n is a, c, g, or t
agcacgggagaagggacccagttctacctgtttgagaacgtggacaatgcacaacagttcaaacagttgtaccgggccaggatgaatgccttggacttgaacctgaagaccaaggaaaggattgtggaggaggccaacaaggcctttgagtacaacatgcagatatttgatgaactggaccaggctggctncttgttggccagagagatcctggaggacggantcccagtgcacgatgggaagggagatgtgcgtaaatgcccctactatgctgctaaaccagacagaggtgccctggagggcagcagctgccccttccgaacagccctggctgtgctgagtcagcccagcctgcagttcattctggccgctggtgtggccctggttgccagcctcttggcttggtactacatgt

SEQ ID NO: 11612 - DNA, 553 bp, Canis familiaris
  misc_feature (27)..(27): n is a, c, g, or t
  misc_feature (50)..(50): n is a, c, g, or t
  misc_feature (56)..(56): n is a, c, g, or t
  misc_feature (63)..(63): n is a, c, g, or t
  misc_feature (78)..(78): n is a, c, g, or t
  misc_feature (81)..(81): n is a, c, g, or t
  misc_feature (93)..(93): n is a, c, g, or t
  misc_feature (108)..(108): n is a, c, g, or t
  misc_feature (136)..(136): n is a, c, g, or t
  misc_feature (153)..(153): n is a, c, g, or t
  misc_feature (186)..(186): n is a, c, g, or t
  misc_feature (194)..(194): n is a, c, g, or t
  misc_feature (218)..(218): n is a, c, g, or t
  misc_feature (226)..(226): n is a, c, g, or t
  misc_feature (228)..(228): n is a, c, g, or t
  misc_feature (264)..(264): n is a, c, g, or t
  misc_feature (357)..(357): n is a, c, g, or t
aacccactgcagaaccctctattggtngaggctgagaagaaggtctcctncaactnctgcagncagggcaccatctgnctncaaatccagatngagaagaccccttcncgccgggggagagggtcatcttcccccnggagatcaacaaccagnccagcaagtgcatcaagacggtcatctttgccntctacggnccacgtgcaatacgagggcttcancccccaancncggagcggcggtcgcgggcggacagcagtgagctgntccggcaggaggccaacacccagatcacgcctttcaacaccaccaagatcgtcagcgccctcaacctcccgcaggtgctgtccgtgagcagcnagcacacgcgacagcgagatcatgagcacccactacgagctggtcagcaccgtccacctgccctggtccctgaccagtgtgaaggccaaggttcccatcatcgtcaccagtgcccctgtggacgcggccagctgccagccggtggaggggacggcgttagccctgagccaagagcgccagaattaagtgcccaaac

SEQ ID NO: 11613 - DNA, 507 bp, Canis familiaris
  misc_feature (44)..(44): n is a, c, g, or t
  misc_feature (319)..(319): n is a, c, g, or t
gaaacagactactgcccggtgaacaggagtgttgagttcgggancctagaaattcttccagtgggcctgaagcttgctgtgtttggcatcttcatcattgtgatatttgtctacataacagtggaaaaggagccgttctttggctaagtgctttaggaacagagcaatgagtgagcacctgagcatgcctctaagccgtcctgctgcagggaaggacagaaaggctgcttgaaaaagggatgcccagccccatagccaggtagctttcctctctgctgctctcacaaaaccctacccaggctcatgatttcaaagccantggggccttacatactgtctagttcaccacttatgtttcgagataagggaacaggccagggaggttgaaggaaatgccaaaagtcacaatgaactgaatccagaatccaaggtgcaaagaaacaaggtaaagaagcagacactctcatcaaagagcttgaggataaggaattccccacatgacggcat

SEQ ID NO: 11614 - DNA, 293 bp, Canis familiaris
taaaccaacacacaacagagcacctgagttcaagaatacagagttcaagccaacccatggcccgtacagacatgatggagtaaagactgagcactacaaaacaggtcttcattctccgagacgacaagcgttggatagtatagagcccatgtccagggtcctcagccccctgagttctcagatcaccccttacagttccaccgtctctttgccttctaactttctgtgtaaaactaactctttgccttcagtgctagatacaaacgaagccaattattctgacactatctctg

SEQ ID NO: 11615 - DNA, 555 bp, Canis familiaris
  misc_feature (45)..(45): n is a, c, g, or t
  misc_feature (70)..(70): n is a, c, g, or t
  misc_feature (430)..(430): n is a, c, g, or t
tccgggaaactatggagcctggtagttagacttaaggagtttggngccgtgtttgaggttaaaacaaagnctatcaaaaagtttggtcatcaccttcagatcctgcacattttgaagtggatgcctctcatgaaaaattagaaggcgtgttcaaagcagatagcatgaatttcagcagtttttctcaagacttaactcactcacattttcccttgtatatggataccaacagtaccacttcagactcgcctcagagtgaaataaagaatgtaaaaagggaagatgaatctaaacccacactttccaaagatatttatggcacactagatgatgaattagatggtactgaaacatagagccaaaatcacagcttttagagagttaattgcaaaagaaacagcatttcaagatcagattattgagactgacnctggcaagttttaaattcgaaagagaagaggatgctattacacactcaagagaagtaaaataagactctgctttggcttataattgagaaaactcagccgatgctcaatcatcacgggctcatga

SEQ ID NO: 11616 - DNA, 573 bp, Canis familiaris
atgtgcaccccaattatccagaaggggggaagatgactcagtacttggagaacatgaaaatcggggacaccatcctttttcgagggccaactggtcgcctcttctataatgggccagggaacttttcaatcaagccatacaaaacaagtgagcctgaaaagaagctggtcagtcacctgggaatgattgctgggggcacagggatcacgcccatgctgcagctcattcgccacatcaccaagaaccccaacgacaggaccaggatgtccctcatctttgccaaccagacagaggaggatatcttggtgagacgggagcttgaagaagttgccagaactcacccggaccagtttgacctgtggtacaccctggacaggcctcctgttggctggaagtacagctcaggctacatcaccgccaacatgatcaaggagcacctccctcctccggggcagtccacgctcatcctggtgtgtggcccaatgcccctgatccagacagctgctcatcctaacctggagaaactgggttataccaaggagatgattttcacttactaataccttccttgct

SEQ ID NO: 11617 - DNA, 591 bp, Canis familiaris
aaagtctgcttgcaagctgctctgagggcttggaatagctgcaatgaatacatgccaagtcgaattattgtgtatcgggatggtgtaggagatggtcagctgaaaacactggttaactatgaagtaccacagtttttggattgcctaaaatctgttggtagaggttacaacccaagactaacggtaattgtggtgaagaaacgcgtgaatgccagattttttgctcagtctggaggaagacttcagaacccacttcccgggacggttattgatgtagaagttaccagaccagaatggtatgatttttttatcgtgagccaggcagtgagaagtggcagtgtttctcccacacactataacgtcatctatgacagcagtggcttgaagccagaccacatacagaggctcacatacaagctgtgtcacgtctactataactggccaggcgtcattcgagtccctgctccttgccagtacgcccacaagctggctttcctcgtgggccagagcattcacagggagcccaacctgtccctgtccaaccgcctgtactacctctgaccctcaggagacgacgaaacgcagccgttt

SEQ ID NO: 11618 - DNA, 183 bp, Canis familiaris
ggaacaagttactattactggcatcttttgcgtgtgtcaaggaaaggacttctttgcaaactcaactaaataatgcatagtggtcaatctcatgtagggccactactctacctcacttaggatgaagaggtagtgtgtcgtcaaactcctgaattctagtttacttggcactcaaaatcacta

SEQ ID NO: 11619 - DNA, 129 bp, Canis familiaris
gattgttccattgcagccactggcaaacggccgtccgcccgcttcccccaccagcggaggaagaagaggagggagatggatgacgggctggctgagggagggccgcagcgatccaacacgtatgtgatc

SEQ ID NO: 11620 - DNA, 74 bp, Canis familiaris
tctatctgcccgtggtattggaatgaatggaaataacacagcagcagggaagagagtaggagaatgtactcatc

SEQ ID NO: 11621 - DNA, 577 bp, Canis familiaris
gctgttaaagtcgattcacccgggaaaagatctgatattatttctaaagttgaggctcgagatatcacagaaatggctaacaaggcttccaaagagcctgttggttgtgtaaataatataggttttcttacttcgctggcccagagtgcaagcagagatagcttacagagcacacgtggagcaggcaggcttcggacctctggaatcgggctgtctacaagccagcattttaaggaggaaaatcttaggaaaaattctccccagttagaacctacagatttttttctatctgcccgtggtattggaatgaatggaaataacacagcagcagggaagagagtaggagaatgtactcatcacctgccacctgtgaaagcccctattcaaacaaagaagaaagcagcaaagcattgtttcctttgtgggaagaaaactggactggctactagctacgaatgctgtggaaacaacttctgtgcatctcatcgctatgcagaaactcacggctgcacctatgattacaagagtgcagggaggagatatttacaggaggcaaatcctgtggttaacgcaccca

SEQ ID NO: 11622 - DNA, 574 bp, Canis familiaris
aaattctacgaagcataggtgacgaaagaactatggtttttgttgagactaagaaaaaagcagattttattgctacttttctttgtcaagaaaaaatatcaacaacaagtattcatggtgaccgagaacagagagagagagagcaagctcttggagattttcgctgtgggaagtgtccagttcttgttgctacttcagtagctgccagggggctagatattgaaaatgttcaacacgttatcaattttgatcttccttctactattgatgaatatgttcatcgaattggacgtactggtcgttgtggaaatactggcagagctatttccttttttgatcctgaatcagataaccatttggcacaacctttagtgaaagtactgtcagatgctcaacaggatgttcctgcatggttggaagaaattgcctttagtacatatgttcctggcttcagtggtagttcaagaggaaatgtatttgcatcagttgatactagaaagaattaccagggcaagagcactttgaacacagcagggttttcttcttcacaagctcccaatccagtagacgatga

SEQ ID NO: 11623 - DNA, 555 bp, Canis familiaris
tgtggagaaccaccctttttggcaacctcagaagagaagctttttgagctaataagaaagggagaactacattttgaagatccactctgggattccataagtgattgtgctaaaagtgttttgaaacagcttatgaaagtagatcctgctcacagaatcacagcgaaggaactactagataaccaatggataacgggcaatatgctttcctcagcaagaccaactaatgtgttagaaatgatgaaagaatggaaaaataacccagaaagtgatgaggaaaacatggcagatgagaagaacaactggtccattcaagaaaagttcaaaggttatcaatccagcgggcccagcggaaatgtccaggataatagtagcacttcggatgaagaggaggaaaaacagcccactgcgaccagtaagaaggaaaacgtggacaacttggacgcgaagtgcacagcttccccctctggcagacaccttctccctgggctcaaaggagagccccccacgactgcaggccaaggaggggcaaccaaatccactgcgaagtccaat

SEQ ID NO: 11624 - DNA, 499 bp, Canis familiaris
aactgggactgttctgttggcctcgacggccccacctactggggcaaggaactccccggggggcccagcgcggactctaccatttcgtggggtgggcctgcgggctccgactgcaccacgtcctggggctcggggctgcaggcggactgcaccacctcttcaaaggggtaccagacttcagatctccccacgtcctccgaacccagccagcagtcggaccgcgtaaccttggcttgttaccccaaaagtaaccaccgaggtcccattcagctgtggcagttcctcctggagctgctccgagacgggcagcgtagcaactgcatccgctggaccggcaacagccgcgagttccagctgtgtgaccccagagaggtggcgcggctgtggggcgagcgcaagaggaagcccggcatgaactacgagaaactgagccgaggtctacgctactactaccgccgcgacatcgtgcgcaagagcggtgggcgcaagtacacgtacc

SEQ ID NO: 11625 - DNA, 231 bp, Canis familiaris
acccagcccgagatggagtatgactgtgagaatgcccgctattaccaacctgggatgcgggacacccctggcctgagcatctatgaccaaaagaagtgtgaaaagttggttctgtccttgtgctgcaatagcctcagcctgcccttccacgagcctgtcagcccgctggcccggcattactaccagattatcaagaggcccatggacctgtcaatcatccggaggaagctg

SEQ ID NO: 11626 - DNA, 182 bp, Canis familiaris
aaatgctgttattcatcctccgagactagtaacttcagctgcttcgtcccattaaaggataagcccacacagatgttccggatgtttgggtttggtatgatcagcatgatcatgctgggatgtctgcccatttattgctgtactctttgccggaggagcaaatgggccaatcctttacgaag

SEQ ID NO: 11627 - DNA, 195 bp, Canis familiaris
gatgctgaaatgtcagggacagcagaagaggaggaaggtgcaggtgatgataaagagcaagagaccaaagcattattttcccactaagaagaatgtgaaccattcagagcagaggagactgtcccagtcatctaaacctgatggagcattttagtacaaaaattaattgttatttttgtcatatttacttccaaa

SEQ ID NO: 11628 - DNA, 442 bp, Canis familiaris
  misc_feature (72)..(72): n is a, c, g, or t
  misc_feature (201)..(201): n is a, c, g, or t
agatttgtcagcttgtacctggccccctggttcgacgacccactgaccacaaggatgaatggaacatggccntcttcctagaggtctctccgtgggagcacatgctcttggggacaccacctgcacagttccgttggctttgatacgcttgcaggccacttgccgactgtggaatccttcaccgcaagacacagagcactnctgaccatgcacccgtgagccacctgagaacaaaaactatggcagcttagtgaggactgcaatgtcagatcccagagggagtgtctggaaaaggaaaaattgagcaacagaattaccagattaaaaccgtcattccccaggcttctccagacaaccagaggtatccgtggcacagaaagatgaaggaccctctgtgtggagagccctagggttacatgacatctaagtcatctctcgtaga

SEQ ID NO: 11629 - DNA, 306 bp, Canis familiaris
gagttcatctgtggagatttcctcctgctggcttctcacttaaaggctgatgttgtatttcttagccccccttggggaggaccagactatgctactgcagagacctttgacattaggaccatgatgtctcctgatggatatcctttagaagggctttcccagaagatcactaataatattgtttattttcttccaagaaatgctgatattgaccaggtggcatccttagctggacctggagggcaagtggaaatagaacaaaactttcttaataataaactgaagacaatcactgcttattttggg

SEQ ID NO: 11630 - DNA, 175 bp, Canis familiaris
  misc_feature (144)..(144): n is a, c, g, or t
agctatgatcctgcctccatgaaagtcgtcagcaatgcatcctgcaccaccaactgcctggcgccccttgccaaggtcatccatgagcgatttgggatcgtggaagggctgatgaccacagttcattcctatactgccacccanaagactgtggacgggccatcaaagaaggcct

SEQ ID NO: 11631 - DNA, 527 bp, Canis familiaris
  misc_feature (72)..(72): n is a, c, g, or t
  misc_feature (164)..(164): n is a, c, g, or t
aaggtcatccatgagcgatttgggatcgtggaagggctgatgaccacagttcattcctatactgccacccanaagactgtggacgggccatcaaagaaggcctggcgagatggccggggcgcccaccagaacatcatcccagcctccacgggggctgccaaggntgttggcaaagtcatcccagacctcaaagggaagctgacaggaatggcgttccgggtgccaaccccagacgtatctgttgtggacctgacctgccgcctggcccagcccaccccatacgaggccatcaaagaggccatcaaagcggcagccaaggggcccctcgctggcatccttgcctacaccgaggatgaggtcgtgtccacggactttgtgggcaacacccactcgtccatcttcgacgctaacgccggcatcgcgctcaacaacagcttcgtgaagctcatttcctggtacgacaacgagttcggctacagtcaccgggtggtggacctcctccgctacatgttcaaccgtgaccagtg

SEQ ID NO: 11632 - DNA, 49 bp, Canis familiaris
aggaaggcctcatgggacagacactgtcaacacttggcgcaggcctcta

SEQ ID NO: 11633 - DNA, 223 bp, Canis familiaris
gcacacccagcagccggtcactgaggcccccgggccgggggtggccagtgtggcatcctggacccaaaattggcaggtccaggggaaacagagagaaaagtcctcgttacacagtttggggtgggggtggggtggggtgggctgaggtcgggcggtgacagccatcccttcccagccccagaagcgggccggaggagcagggacaacaaacgacaccacccag

SEQ ID NO: 11634 - DNA, 457 bp, Canis familiaris
  misc_feature (327)..(327): n is a, c, g, or t
atctacaacctgattcaccttgatcccagaactcgggaaggtttcaccttgctgcatctagctgtcaactccaacaccccggttgatgatttccacaccaacgatgtctgcagctttccgaacgcacttgtcacaaagctgctgctggactgtggtgctgaggtgaatgctgtagacaatgaggggaacagtgcccttcacattattgtgcagtacaacaggcccatcagtgattttttgaccttgcactctatcatcattagcttggttgaagctggcgctcacactgacatgacaaataaacagaataagactccgctagacaanagtaccactggggtatctgagatactacttaaaactcagatgaagatgagtctcaagtgcctggctgcccgagcagttcgggctaatgacattaactaccaagaccagatccccagaactcttgaagagt

SEQ ID NO: 11635 - DNA, 541 bp, Canis familiaris
aaggcagcctcaactcctagtaaagctgagatctttgaacaggagatcaagagacttgctgagtttactgccagaaacattaattggaagtatgtgtaccattcatttgttgatattttatcgccaaattcttggagatgtactcctgaaagacaggacgagcatgcaaagtgctgatttaattagtaacccagtgttggccaccttccccaagctcttggagcagcctgacatgatggatgcactcaggagttcctgggctgagaaagaaagcacattaaaaagatcagagaagagagacaaagagttcctgaaggccatgtttctcctggtttaccacgactgtgtggtccctcttctgcattccacactcctgcccccattcaggtgggcagaagaagagacagaggctgcccggtggaaagtaattgctgacttccttaagcaaaaccaagaaaatgggggtgccctccaagctctgctgtcaccagatggagtccatgaaccttttgacatttcagagcagacctatgacttgttg

SEQ ID NO: 11636 - DNA, 331 bp, Canis familiaris
gcagcttggatctgcccagccctgtgtctctgtcagagtttgggatgatgttcccggtattgggccctcgcagtgaatgcagtggagcctcatcccccgaatgtgaggtagaacgaggagaccgggcagaaggagcagagaataaaacaagcgacaaagccaacaacaatcgaggtctcagcaacagcagtggcagtggcaagagccaaagcaacacctcccgtgagggccaggccttggagaacaggatgaagcagctctctctccagtgctcaaaaggaagagatgggattattgctgacataaaaatggtgcagattggctgatccat

SEQ ID NO: 11637 - DNA, 419 bp, Canis familiaris
  misc_feature (43)..(43): n is a, c, g, or t
  misc_feature (81)..(81): n is a, c, g, or t
gaaaattcccaatgagcccatccggggaaagcgacatggagcntttgtgcaggcagagataaaaccagggagtaggccaanagttcctaagggaacagaggtattacggaatgctccggggtcatgctcatcagaacagtccaaaaaaacagagaaaggaaactcagcggaaagcaaaatgatctcaccaggtctctgccgacaaaattccccagagctgctagagactgaaactcacttatcagaaacagacgtcagagaggcagccaaggcatgccccagaagtcctgagagaagggagaaggttgcagacatcttccaaataactgcagtaaatgctcttctccccaggcatgatcgtttaaatccaccaataaaaagtcaggataaatcaggataaattaccttcttcaagacaa

SEQ ID NO: 11638 - DNA, 85 bp, Canis familiaris
acaaaaatctaatccttggaatggagagaaatttcagaatcatacaaaccctcacaggttgctttctcttatatcaataacctca

SEQ ID NO: 11639 - DNA, 187 bp, Canis familiaris
gaggagcccctgcagaaacccgtgccctgctggctctacctgggggatctgaagatgtggtccacccgcctgcgacctgagatgcaggtggaaacctgccatgtcccgtgcaaaacatcaacgctggatttcatcacctttgacaactttgagatcagcgaggagtcagaatccgtgtggctcacct

SEQ ID NO: 11640 - DNA, 462 bp, Canis familiaris
ttgtgcactgctttgcaggcatctcccgcagcaccaccatcgtgacggcatatgtgatgactgtgacggggctaggctggcgggacgtgcttgaagccatcaaggccacccggcccatcgccaaccccaacccaggctttaggcagcagctggaagagtttggctggggcagttcccggaagctccgccggcagctggaggagcgcttcggagagagccctttccgcgacgaggaggacgtgcgcgcgctgctgccgctgtgcaagcgctgccggcagggctcggcggccgcggccgcgtccccggcggcgcactcggcggcctcggagggaaccctgcagcgcctggtgccgcggccgccccgggaggcccaccggccgctgcccctgctggcgcgcgtcaagcagactttctcttgcctcccgcggtgtctgtcccgtaaaggcggcaagtgaggatccc

SEQ ID NO: 11641 - DNA, 325 bp, Canis familiaris
gagcagagagcatcaatccgattcaagaccactctcatgaatactctcatggatgtccttcgccacaggccaggatgggtggaagtaaaggatgaaggagagtgggatttctactggtgtgatgtcagctggctccgggagaactttgaccacacctacatggacgagcacgtgcggatcagtcacttccgaaaccactatgagctgacccgcaagaactacatggtgaagaacctgaagcgattccggaaacagctggagcgcgaggcgggaaagctggaggcggccaagtgcgacttcttccccaaaaccttcgagatgccat

SEQ ID NO: 11642 - DNA, 150 bp, Canis familiaris
tccccgtggagaactacgtagctcagcgctatatcgaaaacccctacctaataggaggccgcaagtttgatctgcgtgtctatgtgctggtgatgtcggtggctcctagaggtcaacgcgtccccatcgctgacagccagcagccaggag

SEQ ID NO: 11643 - DNA, 295 bp, Canis familiaris
  misc_feature (26)..(26): n is a, c, g, or t
  misc_feature (51)..(51): n is a, c, g, or t
  misc_feature (94)..(94): n is a, c, g, or t
caccagacttcagtcgggctactggncacccagcagtcccgagatcggtcnccgtcccctcttcgggggcaacgtggtcccgagccattgcccncccgccggaccaggaccttctcagcgacggtgcgggcttctcaaggtcctgtctacaaaggagtctgcaaatgcttctgtcgctccaagggccacggcttcattaccccggccgatggcggccccgacatcttcctgcacatttccgacgtggaaggggagtacgtccccgtggaaggcgacgaggtcacctataagatgt

SEQ ID NO: 11644 - DNA, 266 bp, Canis familiaris
  misc_feature (35)..(35): n is a, c, g, or t
  misc_feature (93)..(93): n is a, c, g, or t
  misc_feature (146)..(146): n is a, c, g, or t
gaagatagcgaagctcctctgcagagaaacaaatncaaaagccctagaaccgggtggtgccgagctcggggctctagcccggctactagctgncacggcgggaagtggagccagcgcggtgagcacctgcctgtgctactgtgccntctacctggccatctggaaaactactgctgcaccaacgcaagaaaaatgtaaaaaggaagccttgggtgaggtgacatttttcaggtgttattcaaatcctacagctgggtaaatgcaag

SEQ ID NO: 11645 - DNA, 366 bp, Canis familiaris
  misc_feature (88)..(88): n is a, c, g, or t
  misc_feature (147)..(147): n is a, c, g, or t
actctcacctaagtcagcgagctgtccccaccaaggctgcggggtggcagctcggctcacccatctcagctgggtttggcgtcagtcnggatcctctcaaggtgtcacagctgtctcccctgtcacgaagactccgatgtgaccagngcacgagcctaccagaggaagccctcgatgatgtcacccagtccctctaccacctgtctgctcccggacatggggacatcatcagatgcccccattccaggggatgcagggagggggaactttgcactaatcaggccccagctcacctcacagacatggcacatccatcagggctgttcaaacactgtggaaacaagacttgggcgcattctcaattcc

SEQ ID NO: 11646 - DNA, 500 bp, Canis familiaris
gagctgagtctcataacaccattaagggtcagtggctggttaggcttcaactcattaaccatccattatgtgccttggaggagtataaaagtcataaattccacattgggtcagataagccacttacctaacaccatgttctgtccctgaagtggaaacgagagttcttccattaaattggcctcataggttaagggctccgaacatttttgaattcctcttcataatccactataaagtaatcatctgtgaatttgacatactgattttttaatcttacaggcccttaggatagagttccaatgtttatcctccctttccataaagaagtacatattttcatttgtctgcaaactattccctttaagcttcagaacaactcctgagacaatgtttaccatatgatcttatgattcagctttcttctctgttctgtgattcctctctacagaagaccagaggagtcctaaaaccacattttttctcccaagtcagtcata

SEQ ID NO: 11647 - DNA, 214 bp, Canis familiaris
ggacagcctgcgagactcagtcaaggtcacggacagcctgcgagactcggtcaaggtcacggacagcctgcgagactcggtcaaggtcacggacagcctgcgagactcagtcaaggtcatggacagcctgcgagactcgtcaaggtcacggacagcctgcgagactcagtcaaggtcatggacagcctgcgagactcggtcaaggtcacggaca

SEQ ID NO: 11648 - DNA, 495 bp, Canis familiaris
ggagctgatattaacaaggcccttcttgcaaagagaaaaagactagaactgtatactaaggcttctctcaaaaccagcaaccagaaaattgaacatgtttggaaaactcagcaagagcaaaggcagaagcttaaccaagaatattctcagcagtttgtgactttgtttcagcagtgggaaatggatatgcagaaaattgaggaacaagaagaaaaactagctaacttgtttcgacagcaacaaaagatttttcaacagtctagaattgttcagagccagagactgaaaacagttagacagctatatgagcagttcgtaaagaatatggaagagttggagaagaatcatgataacctacttactggtgcgcaaaatgaacttaaaaaagaaatgtctatgttgcaaaaaaaaattatgatggagactcagcagcaagagatggcaagtgttcgaaagtctcttcaatccatgttattctgatgactctttgaagga

SEQ ID NO: 11649 - DNA, 198 bp, Canis familiaris
gagcctgtgcataaggttggtgttttcttagactatgagtctgggcatatagcattctacaatgtgacagatgagtccctcatctacagtttccctcccacctctttccaagaggctctcaggcctatcttctccccttgcctcccaaatgaagggacgaacacaggccctcttatcatctgttcaccgaatagttat

SEQ ID NO: 11650 - DNA, 560 bp, Canis familiaris
gagctgtcactttggatcctaatacagctcatccctgtctggtcttatctgaggatcggagaagtatatgtctcaggaatgtccagcaggatgtgcctgacggccccgggaggttcatcttcgaggccaccgtgttgggggtggagagcttcacttcagggaggcactactgggaggtggatgtggaaaaggcaaccaggtggctgttggggatatctgaagactctggcagtggacacagtgacctacccactgctgccagagataaagtcttactcataggttctaggatgggaactaattacacgttctgggtctttccccctctgaagaaggtctccttgaggggagagcagatgcacaaagttggagtcttcctagactgcaagtatgggcagttatccttctatgatgtgacagatagatctctcatttataatttctcttctcttaccttccggggagctgtcagacccatattttctctttgtatcccaactggaggcacaaattctgactcactcagtatttgctgtcctcatgttgcgtcttgtgatgtt

SEQ ID NO: 11651 - DNA, 542 bp, Canis familiaris
gttgatggaccaggttcgcttccaagaactccagctccaactggagcagctgaccatcctgggggccgtgttgctggtctctttcagcatggcagccccaggaatttccagccaggctgactttgctgagaaactcaagatgatcgtgaagattctgctaacagatatgcatctgccctccttccatctgaaggatgccctgactaccatcggggagaaggtctgcctggaggtgagcagttgccttgccctgtgtgggctcactcccttcaccgcggaaaaggaggccgtgctcaagggccagatccaggctgtggccaatcccgacgaccccatccgcaggatcatggattcccgaatcctgatcttcttagagagctaccttgccacaggtcatcagaagccagtgcccacggtacccgggggattgggcccggttcagagagagctggaggaagttgctattaaatttgtgcgcctggtcaactacaacaagctggtcttcagtccctactacgatgtcatcctcagtaaggtcctcg

SEQ ID NO: 11652 - DNA, 424 bp, Canis familiaris
tggagccgtattcgtacctggtaaaagcaggagttgcttccagtgataagctacaggagtggctccggtctccccgggatgcagttagtccaagatatgagcaagacagcggccatgacagcggaagtgaagatgcctgctttgattcttcccagccgttcactctggtcaccataggcatgaagaagtttttcatacccaagtcagccacttctgccaatgaacctgagaatagggttcttcccatgccaacaagtatagggattttccttgactatgataaaggcagagtggctttctatgacatggatcacatgaaatgcctttatgagcgtcaggtggactgttcgcacacaatgtacccagcatttgcattaatgggcagtggaggaattcaacttgaggaacccatcacggcaaagta

SEQ ID NO: 11653 - DNA, 59 bp, Canis familiaris
gagaggagcagaataatgccttggtgtaaccttcgtaactaattacatatcatccaagt

SEQ ID NO: 11654 - DNA, 161 bp, Canis familiaris
  misc_feature (43)..(43): n is a, c, g, or t
gtgaactggacagagccacagaaccaccagccctgcgggaggntggagcctcagacagtgcccagggcaagctggcctggctggaggccgccctgcagcgagccaagcacgacatggtccggcagctgcgcgagtaccaggacctcatgatcatcaagctg

SEQ ID NO: 11655 - DNA, 463 bp, Canis familiaris
gggcctccatcgactttgagcaaacatcagccacatacaaccacgacaaggctcgctcctactggaactggatccggctttggaactatgcgcagcccccagacgtgatcctcgagcccaacatgacgcctggcaactgctgggccttctcgggtgaccgaggccaggtgaccatccgaatggcccagaaggtctacctgtccaacctgacactgcagcacatccccaagaccatctcactgtcgggcagcctggacactgctcccaaagacttcgtcgtttatggcatggaaggctctcccagggaggaggtgttcctgggggcatttcagtttcagccagagaacatcattcagatgttccagctccagaaccagcctgcccgagcttttggtgctgtcaaggtgaagatatcgagcaactgggggaacccacgctttacctgcctgtaccgagtgcgtgt

SEQ ID NO: 11656 - DNA, 303 bp, Canis familiaris
gcaagaattattgcccagggcctcatgaagtacaatgcagagggccggatccagaatatccgcctcatggacagtctgaatgcctcagggcagatggctccagggatggtgggctggttaataggcagcatgagcctccagcatcagcaagaaagcaggcccttcaataacaagattgtaaagacacatgtgtgcatgaacctcgttgtggagttctggctggagaaagatgagtttggccggagggatctggtgataggagattgccatgtggagccgagtagcatctacatgacagtccta

SEQ ID NO: 11657 - DNA, 453 bp, Canis familiaris
tcagcaagaaagcagcgccaacatcaccaacattcagctagactacagtgggatccagatgtctttccataaggagcggttctcagcaaacatcttatttgaatttgacattgacttgagactgcccttcaataacaagattgtaaagacacatgtgtgcatgaacctcgttgtggagttctggctggagaaagatgagtttggccggagggatctggtgataggagattgccatgtggagccgagtagcatctacatgacagtcctaactgaagatatctcaccaaagatgaaacattttctccacaacttcagagggaccctggcaaaagttatcccaaacccagtagaaagtcaggtgtgtcctctaatcggtgaaatcctcagacagctggacgtgaaactgatgaaaagcctcatgggtcccgagatccctgcccatggctgctcaat

SEQ ID NO: 11658 - DNA, 572 bp, Canis familiaris
gtgattctgaacatagccactgtcagtgtgagaatccagttctcccaggaccaaccaaaaagcccttcagtggtgacaagattgaattgcttatcctgaaggccaagagaaatctagagcattgtagtgaagagttaccgaagtctacaaaaaaggatgatagtccttgttcgttagataaacttgaagcagaaagatcatgggaaaatattcctgttactttcaaatctcctgttcctgttaactctgatgatagtcctcaacaaacttcacaagcaaagtgtgctaacgggttccttgaagattttttaaatgatgataatcagagttgtaccctttctggagggaaacatcatggtcctgttgaagccttaaaacaaatgttatttaatcttcaagcagtacaggaaagttttaatcagaataaaacagcagaactgagagaagagattaatcaagtttcagaagacaatttctctaaattgcagttgaaggaaagtatggttcctattactaggtcacttcaaaaggctttgcaccatttatctcgcctgcgagacctggttgatgat

SEQ ID NO: 11659 - DNA, 523 bp, Canis familiaris
atcagctcatagcagttgacaaccaacttctgcatgtaaaggacttggaatttttactgaacaaattgatgaagctgtggaaaatggatctaaatggaaatcctgtttgtctcaaacccaaatacagagacagactgatactggtgtccaagtcactagaatttcttgatggaaaagaaattagaaacatggaaagacaattcctaataaattggaaagcatccaaagatgccaagaaaatcagcaagaaaaggaatagtcaaactgaagatgcaagtaactcacacataagtaactttgaaacaatgcatcacatagttgcttattacctacagatgggtaagccaaaagtagtttttttctctgatatacacagataccttccaaatggaaatgcatctgcagaaagctcccaagaagataaccctaaaattattgaagatctggggaatctctctttggtggaatctgaaagcttgctgacaaaagatatacttgaacttcactttctctgtaactcaag

SEQ ID NO: 11660 - DNA, 124 bp, Canis familiaris
tcaaaaaagataactgtttccagcaaggcttctaaaaaattccatggaaatctatatcgtgttgaaggagtgattccagaatcgacaactaacctatctgatttcctctacaaacctgaaaaca

SEQ ID NO: 11661 - DNA, 131 bp, Canis familiaris
cagttctaacagtgtggattttccagcatatcctccatcttcaaattatgtccgtggttataaccatgcttgtggctatatatgttctcctctgcaagagaacccagcacattccaaactagtgatgttta

SEQ ID NO: 11662 - DNA, 490 bp, Canis familiaris
aagctcctacatggttgactatcaaccctacgggaaggacaaatactccagggtcacaccacaagagcaggtgaagctggatgcccaactccgggacaaagaattgtataggcccatccccagctccaagcccaagctagaggatgggtaccccgccttcagaacactccacatgaccgccagagacctggggcagcccggcttcttccccccgcaggaccatgggaccgcagcagaggacgaatgcaggttcaccagtatctgccgttccgtgtaccccgcttgccaccccctgtacctggcccaaggtgatcccaaccggggccgccagagcaccggctttccatgcctcctggagcctgagcgccagcctgcggcggacgtgggcaaaggctactttctactgcctggctgtctctgtccttatcaccacaaagtcaagttccccatcttgaaccgatggggccccttgatgccattttaccagtag

SEQ ID NO: 11663 - DNA, 562 bp, Canis familiaris
gtatatttgccttgattctgtagaaagttgtaatctgtttaaccagcatagtgatacagatgacagcggagtcagctgggaatctgagtctgagagccttaatgaagcactgcggaggtttaataagaatgtggagacatttcctcctctgacggattttagaacagaaatgccttgccttgcagaatatgatgatggcttatggtatagagcaaagattgtgtctgttaaagaatttaatcctctagctgtcctggtacaatttgttgattacggatcaactgaaaagctgacaataaacagactacgtcaaattccacttcaccttatgcagtatccagcccgagccataaaggttctcttggcaggatttaaacctcccttaagagatccaggaaagacaagaataccatattgtcccaaatggagcatggaagcattgtgggctatgatagactgtcttcaaggaaaacaattgtatgcttcttccatggctcaggcaccagaacaaatagtgaccttatatgaagatgaacagtatccagttcatatgtcacttgta

SEQ ID NO: 11664 - DNA, 150 bp, Canis familiaris
aagatgctgatgaggctatgagtaaatatctatcagaaaaattaaagttgagagacagatggcttggagtctggaagactaaccctgagttattctttgtgaaatatgaagaagcttctatcccttttgttgctatactggttgaggtaa

SEQ ID NO: 11665 - DNA, 336 bp, Canis familiaris
  misc_feature (58)..(58): n is a, c, g, or t
caagcggcgcccgagaaaccgagaactggatactttgcctcattcacttgtactgtancgatgtatataatttggtggtatttcactatttaatttttaagaagcctattttactagtgttttatatgaaaaaaatactgcagaagttaaacctgtgttgtatttttcctgagatgctttgtgttagtgactactgagaccctttccgctcggtttttatatgcgggaaacagagtttgtacgggctatttttgtatcacccggtaacttgcaaacagaccaaatgagtgtgtggagggaggcgcaggccggggcccgttgacacgctgtcgtttg

SEQ ID NO: 11666 - DNA, 289 bp, Canis familiaris
tggcagaatccgcacatgctcttcctggatgagcccactaaccacctggatatcgagaccatcgatgccctggccgatgccatcaatgagtttgaggggggtatgatgctggtcagccacgacttcagactcattcagcaggttgcacaggaaatctgggtctgtgagaagcagacaatcaccaagtggcctggagacatcctggcctacaaggagcacctcaagtccaagctggtgggcgaagagccccagctcaccaggaggacccacaatgtgtgcacccggacat

SEQ ID NO: 11667 - DNA, 544 bp, Canis familiaris
  misc_feature (367)..(367): n is a, c, g, or t
  misc_feature (424)..(424): n is a, c, g, or t
gttctatagctatcttcagtctggcatgtgatcagagattttgatacttttggatgtgtaaattggacggggcatggctgatggcgagagagaagagtttttggttccccattccaactcttctgcagtgtgtttgtggcagtgttgttagtcaacttgtagtgatcaggttgagagatggcataaaactcccccaaagtgcaaaaggaacaacaacccattcacagatgctgttcttctcccacaggcctggaagtaactcctttttggaaactgcactctcagttccttttccaacacctgccccatctgccatggagaggcaccgtggagaatgctttctaactctcccttgttcctttacatnctatacatgggttatagactctgaactctggattggcattttctctctttggaggancatggggtcaaacagtgtgaggaagcagctttttctcaagtttggctcaacatgctttaggtcattttggcttaagagaacaggctcactcacagggtccagtctaaatctctgtgttct

SEQ ID NO: 11668 - DNA, 186 bp, Canis familiaris
caggcaggcagagccagagcccaagacatcagcgggcctctgggcatttctcggtacagacaatgaaatggcagcttatgatgtgccttgtggccgcccggaagtgacgaccatctgtttggaagatttcccaactatcaccccgtgcacagcgtgtgcacgagctgctgtaagccttgctctcag

SEQ ID NO: 11669 - DNA, 446 bp, Canis familiaris
  misc_feature (79)..(79): n is a, c, g, or t
  misc_feature (95)..(95): n is a, c, g, or t
  misc_feature (105)..(105): n is a, c, g, or t
  misc_feature (118)..(119): n is a, c, g, or t
  misc_feature (123)..(123): n is a, c, g, or t
  misc_feature (125)..(125): n is a, c, g, or t
  misc_feature (157)..(157): n is a, c, g, or t
  misc_feature (271)..(272): n is a, c, g, or t
  misc_feature (284)..(284): n is a, c, g, or t
  misc_feature (359)..(359): n is a, c, g, or t
atgagatcagacttgagagcctgggggttgggggggtgggcagggggaaataggaggaggagagactgtaatacaaacnctaggagagcaagtgnctggaaaganctggtgcagaagnngggncnccccttgtaggtgagggtgaccccgagacttngcagagaggggctgcctagatagaagacctggaacaagtgtgagaacccggagatgtacagtctaggctggggctgggggatcataagtaagggctgagatccgagcagcaaanncctggcctcatnccatgcggggccccggaggggaggcttttaccctagagagaaaagcatgggggatggagtgttgggggctttcangcaagcggacagagcacacagcgagcagctggggcgagggagtgtgccttttcttcccggacagtttccttccctcacggttatgct

SEQ ID NO: 11670 - DNA, 293 bp, Canis familiaris
aacctgtccgatgggcagaagtgccgagtgtgtctggcctggctggcctggcagaatccgcacatgctcttcctggatgagcccactaaccacctggatatcgagaccatcgatgccctggccgatgccatcaatgagtttgaggggggtatgatgctggtcagccacgacttcagactcattcagcaggttgcacaggaaatctgggtctgtgagaagcagacaatcaccaagtggcctggagacatcctggcctacaaggagcacctcaagtccaagctggtgggcgaaga

SEQ ID NO: 11671 - DNA, 565 bp, Canis familiaris
gaaaattacgctgctgccgtggattgttacacacaggcaatagaactggatccaaataatgcggtttattattgcaacagggctgctgctcagagtaaattaggtcactacacagatgcaataaaggattgtgagaaagccatagcaattgattcaaagtacagcaaggcctatgggagaatgggactggccctcactgccataaataaattcgaagaagcagttacaagttatcaaaaggcgttagatcttgaccctgaaaatgattcttacaagtcaaatttgaaaatagcagaacagaagttaagagaggtatccagtcctacaggaactggattgagctttgacatggctagtttaataaataatccagccttcattagtatggcagcaagtttaatgcagaaccctcaagttcagcagctttctctgggcattggtgttatgactggaagttccctaattcataccactttgcctctttactacaggggacagcagtttgctcagcagatacagcaacagaatcctgaacttatagagcaactcagaaatcacatccgga

SEQ ID NO: 11672 - DNA, 448 bp, Canis familiaris
  misc_feature (44)..(44): n is a, c, g, or t
  misc_feature (50)..(50): n is a, c, g, or t
gaagggctatatctcccgagttggagtggtggactgctttgacnccaacnccggggatgtggtccagtgtatcaccttccccattgacttcaaccaccggcccctgctctctttccatcaggacaacatcctctgtgtacacagccaccggcagagtgtggaaatcaatctgcagaagataaaggccaacaagacgaccacctcggtgcctctcttgcctaacaactgccccttggatgtgtcccatgctatatgctccattggagacagcagagtgtttgtgtgcgggggtgtcaccacaaccagcgatgtccagacaaaggactacaccatcaacccaaatgcctacttgttggaccaaaagacaggcgagtggaaaaccctggcccccccaccggaggcactggactgtcctgcctgctgtctagccaagctaccgtgcaagatt

SEQ ID NO: 11673 - DNA, 280 bp, Canis familiaris
  misc_feature (58)..(58): n is a, c, g, or t
  misc_feature (120)..(120): n is a, c, g, or t
aataacttttctcctcctcttctcaacgtgagcaagtcttatttccaagaagcttggntaaaacatgcctcatcattccgagatgcaggtattacacacatgaagaacttgatgtgacanggagtggaactcgtgaaaagcactgctgagatgtctaatgtataaatccaagggcttccatactgacgtacttggcaatcttttgcatgttgtgtttcaaaggaatgtttcacttagtaaatcagtcaaaagactattcttttgttgtgattgtttccca

SEQ ID NO: 11674 - DNA, 353 bp, Canis familiaris
  misc_feature (213)..(213): n is a, c, g, or t
  misc_feature (220)..(220): n is a, c, g, or t
  misc_feature (235)..(236): n is a, c, g, or t
  misc_feature (238)..(239): n is a, c, g, or t
gcaaacgtggtatgggtccaacccatgaacaggttaagcttctgacaagagagggaaaagacaccccagccaatgggagctcgtgctggtgatgtactgctcccagttctgattcattggccgcctagggtttgtcattctatccccgcgtctgcaaacagcgtgggtcggttttctgtagtccagctagctaaactggattttggccgcccngcatatncagctgcagttaggnncnnttgctaacttctaatggaagcagctcttaacgtttctgattatcctcaagaaaaatcttgcgttccttaaaccttgctggaggtcgttggaggtcccctgtgacagaatcacgt

SEQ ID NO: 11675 - DNA, 512 bp, Canis familiaris
  misc_feature (293)..(293): n is a, c, g, or t
gaaaaacttaatcttgaaacagcattacaagaatctattgctgctagacaaatgatggaaagagaaattgagaatattcaaacataccaatctactgcagaagagaattttctgaaagaaataaaaaatgcaaaatcagaagcaagtatttataaaaatagtttgtcagaaatgggcaatgaatgtgaaatgttatcaaaaatggtaatggaaatcaaaacagataatcagattctaaaagaagaactaaaaaaacatagtaaagaaaatatgaaatttgaaaacagcatcantagactttcagaagacaaaatacttttagaaaactatgtaagaagtatagaaaatgaaagggataccttagaatttgagatgcggaatcttcaaagagattatttaaacctaagtgaaaaaatacgtagtacacagagtgacctatcaaaaatgggttatatttcaagaagagagaaattccattttgatacttatgaagacgcctctggtcctaggag

SEQ ID NO: 11676 - DNA, 160 bp, Canis familiaris
  misc_feature (56)..(56): n is a, c, g, or t
  misc_feature (84)..(84): n is a, c, g, or t
  misc_feature (118)..(118): n is a, c, g, or t
agcgggagccgctatgatgccatttgggaaaagggactggttgtgaagggcacatncacattctcagatgggctacagtacgantcggagcactggcattactgtgacagctatgatnggaggttttacaccgagatctgctacggcttgaagcctgcag

SEQ ID NO: 11677 - DNA, 52 bp, Canis familiaris
gaaaggaattccaagtcaactgcatcaattgcttccatctaagatatgtaaa

SEQ ID NO: 11678 - DNA, 407 bp, Canis familiaris
  misc_feature (204)..(204): n is a, c, g, or t
  misc_feature (226)..(226): n is a, c, g, or t
  misc_feature (246)..(246): n is a, c, g, or t
  misc_feature (251)..(251): n is a, c, g, or t
  misc_feature (297)..(297): n is a, c, g, or t
gatgcacggctttacgggtcacaaagactggatggacaagtgtgtgtgtctcttgactgccttctccgagcgcatgcgccgtgtccctgtggcattgccagagatggtccgcgccctctcagcccaccagcagaccctcaagcagatcgtgatctgtggagatccccaggccaaggataccaaggctctgctgcagtgtgtccnctccatctacatccctaacaanggtgctgatcctggccaacnggggncccctccagtttcctgtcccgccagctgcctttcctgagtaccttncggcggctggaagaccgggccacggcctacgtgtgtgaggaccaagcttgctcaatgcccatcacggagccctgcgagttacggaaactgttacaccaatgacttcctcg

SEQ ID NO: 11679 - DNA, 232 bp, Canis familiaris
  misc_feature (146)..(146): n is a, c, g, or t
agactgtggctttttgctgcagacaatggaaatccaaaagctagtgtgaaggctcaaagtatcctaggattgtattattcaacaaaagagcctaaagacttagaaaaggcattttattggcactcggaggcatgtggcaatggaantctggagtcccaaggtgcacttggactaatgtatttttatggacaaggcatccgccaggatactgaagctgccctggagtgcttaa

SEQ ID NO: 11680 - DNA, 512 bp, Canis familiaris
acatcactttgatcagccttcagtagcaccaaggaaaaactactctttcacaagagaggaggtgagacagattgatagggaaaatcagaggcttttgaaagaactctcaagacaggctgaaaaatcaggaagcaaaagtacgattcctagaagatctattgttcatccccctaagttatatcatagtgccctcaacagacagagggaacaacaaaggattgaaagagaaaatttggctttattgaaaaggcttgaagctgtgaaaccaacagttggtatgaaacgctctgaacagctgatggactatcatcgcaatatgggttatctcagttcattaccgtcctcaagaagagtgagatcaactcttggccagtatagccccttgagaggagcttctagaacatccagtgctaccagtggtctcagttgtaagagtgagcgaccagtttttgacacatccagtggcctgttgctaagacctaagccccctaatgttcgtacggcttggttat

SEQ ID NO: 11681 - DNA, 219 bp, Canis familiaris
  misc_feature (145)..(145): n is a, c, g, or t
gcctcggtgccgagaacgacattttcatctacatggcgttgatttacctgggcagcccccacaaaaacctgaagcggatggccatgaagttcatcgggggcatcctgcaggactactttaccgacctctgcttttccctgaagangggcgacctgaaaatcttcaagaaatacttggaggtcctgaagaaggactcagactccgtgagccgcagattct

SEQ ID NO: 11682 - DNA, 136 bp, Canis familiaris
aaagggatgtgaggtttcatgaactggaaccggatccaggatgctctgcaatcacaccctaggatttgtaataagttcaagtgttcatgtcacccttgtcctcattccctcccaatgttccttctcaaagttagag

SEQ ID NO: 11683 - DNA, 568 bp, Canis familiaris
agatataccagcgaagctcctccttgttgtccttcaatgccacgggtggtgagaaggccaagatgggtctggaagcctatgggcgagcccaatctgcctcacctgccaaacccacagatggcctctatacatactggagcgcaggggcagaaaaccagtctgtgcagaacagcaacagcttccacaactggtactcattcaatgatggttctgtgaagaccccaggcccaattgttatctaccagactctggtgtatcctagagccgccaaggtttattggacatgcccaacagaagatgtggactcttttgagatggaattttatgaactcattactacccctcctaacaatgtgcggacagagctttgtgggcaaattcgggatataatgcagcagaatctggaactgcacaatctgacccccaatactgagtatctgtttaaagttagagccatcaacgacaatggtcctgggcaatggagtgacatctgcaaggtggtaaccccagatgggcgtgggaagaaccgagctaagtggggcctgctgaagaacatccagactgccct

SEQ ID NO: 11684 - DNA, 58 bp, Canis familiaris
aggccctgggcaacaaccagtacctgagccaactctttgaggagaacacctactccca

SEQ ID NO: 11685 - DNA, 559 bp, Canis familiaris
ggagaagcttcctattacttgggcttagcacacctagctgctggagagtatgaaacagcattaacagtctttaacacttacagtaaaatctccacagacctggatgatgatctcagcctggggagagcctatgaagcaatagccaaggtcctgcagagccaaggagagatgacagaagcaattaaatacttgaaaaaagttgtgaaaattgcaagaaaaaattttcaaagcctagatgttgtgagagcaagtacaatgcttggggccatctacaatgaaaaaggatactacaacaaagcttccgaatactttcagcaagcttttgacacaacagcagagctaacaaacttgcgtcaaatggatgagacgaaagttcattatggaatagcaaaagctcatcagattatgccgagagttaacaattatatcgagtctgcagatctcactagccttgacttcctgctgtcctggaaggaaagtagaagcaaaattgcatgtgaaccaactatgggaggatctagaagatccacaagggaaagtttatgtcaaatcccagaga

SEQ ID NO: 11686 - DNA, 395 bp, Canis familiaris
ggaactctgagttgcctgggacacggcaaagcgagccgcgagtctgctgtggtgcatcgaccctctcctgaacctaccagccagcttccctgtgagacagctcacctatgagacgttatgccatgagaaatcccaggatagccacgtaaagaaagaaatctcaagcagccaccacgactacggccctctcattccaggcatcagacctgtgagtgaaatcacgttcctaggactttatcctcaccagctatttgactgcaaccacataagaaactccaagggagaaccactcagatgagccaacagagcaatgaaacaaataaataaatcatggttttaagccaccaaaatttgaggaagtttgttaagcagcatatcagacatatttcctccct

SEQ ID NO: 11687 - DNA, 371 bp, Canis familiaris
  misc_feature (325)..(325): n is a, c, g, or t
aaagctgccctcagatgtattggcaaactgctctcaggactgtcctctttccacagaggtctcatttttccatggaatgtgcagaaagaactgggttgggatgtagaggtgaggaggggataaagcagtgattaagaagaagaggacttcacaccagcttcaaccctttggagagacatctttattctgtgcatctgaagagaacagcaccagagtaaggccaacattaagcttgaagaatcagagtttggcattcaggaaaaaattctgatgaagccactatccatggagaaaaagaaagcaattaaaataattttaacaacanagaggctcccaaatttgtggataagtttggacctagctgtgcttgg

SEQ ID NO: 11688 - DNA, 528 bp, Canis familiaris
  misc_feature (94)..(94): n is a, c, g, or t
  misc_feature (112)..(112): n is a, c, g, or t
  misc_feature (172)..(172): n is a, c, g, or t
  misc_feature (174)..(174): n is a, c, g, or t
acacctgctgcattcaagagttcacatacgtctgcagtcacaaagcctacagtatcagataaaaggtcagggatggcgacagcagcagccatcncagatccaggaggaagcncaggagaaagaccatagggggtgcattcggcatgtcctaatattgttgtaagcaagggcnancaagcccttcttgtcttcagagggcacttctagcacatcaggaggagctactggcttcttctcagagggagaacaaatctggtgattccaagagcagaaactactggcaagcctgtggcaaaaacagctaacagctcagtattgagacccttcattacaacctcagagtaaaggctacatgaatgaacaggatggaagccagaggtctccacccagcagtactgactctttaggaaagagcctcaaagccctgcaccacaccatggtgcagaggtggacatctcatataagactgtggaggagatcagtgtcatccaccctcacacaattcatctcaaattctctgctctaatc

SEQ ID NO: 11689 - DNA, 155 bp, Canis familiaris
gctcggcaaagaaaagggagtgtctttgatgaccttgcatgaaaattcccctaaaataggcagcagtcagcagtgaaggaagcctttggagcaggggcatctggaagcagcgaaagtggacacagacagagagggagcatgtcaggtgtgtctta

SEQ ID NO: 11690 - DNA, 478 bp, Canis familiaris
ttatccaaggccatagaccgtggacagaagggacagcaggagacgcctgtctttgtcatcagtcactctgcctccgtaattacattcccctggagataaccaacaggaagaagttgagctcaagaaaggtcataatgaacttggttgctacctaaaacaggattcttccagctaaggaactctgctgagatacagagttgctgaaactaatgcttaccttgggatgacaccaggcctttttggtattacgtttgctacaaaaatagtacctgttcaccatttaggaagcagaaataaactgaaagaaaaactatacaatcaccaataattccaccagaggtaactataaacatttaggcctcttctacatgtatgtgtgcatgtgtgtatacatacatgaaagccattacagagaggtggttcagggcaagcactttagcatgagacagtcctggattccattccaacagtttctcat

SEQ ID NO: 11691 - DNA, 358 bp, Canis familiaris
  misc_feature (161)..(161): n is a, c, g, or t
  misc_feature (305)..(305): n is a, c, g, or t
gagcagcgtcattccagataacattcgtcacaagtttgggagcagcatggtggaccagctggtctccgaggaccaggctcgaagggccatcggtgaggtctttgagggccagaagagggcaaactcgtggcccagcaggatccagagtcccatggaaatcncctccatcttctcagactactatgatttgggctacaatatgcgatcaaacttgtttcaaggggccccccaggagacgaagagcctcatgaaggcctcctatactccagaggtgattgagaaatcagtgagggacatagagcacntggcatggcaggaagacggatgatctgggacggtggcaccagaaaaatgctat

SEQ ID NO: 11692 - DNA, 274 bp, Canis familiaris
attttcataggagctgtgtttggttatattctgcagcccaagttacattaccctgggtattttaagctgatgacatgttaccttcattcttaaatctgtaattttgcaactcaaaacccagctataggatcaaattgctaagagaggcccaaaagaagatccagctcttaggcctacagactggcctatgtcacatcaaatacagaaaaccattccataaagcaaatacctttttcttttctttaaatagagcatccaaaagacttagtgcagt

SEQ ID NO: 11693 - DNA, 197 bp, Canis familiaris
aggcctcacctggaatgttttcaagaagcttctgctgtgccctctgttttgtttcctgacttcgttctttgcttctgattgtggtcggtggtgccaatttcccatttggccaaaaagcatcccggaaaacattgatgtagtaaaccaacatttgctcactgaaaatccagctcactgtgtcccggatttgtctttaa

SEQ ID NO: 11694 - DNA, 59 bp, Canis familiaris
caaaggatttagaccatgacgcatttcaacaaagatcatcaaccctaacaccttagaat

SEQ ID NO: 11695 - DNA, 479 bp, Canis familiaris
  misc_feature (211)..(211): n is a, c, g, or t
  misc_feature (259)..(259): n is a, c, g, or t
  misc_feature (289)..(289): n is a, c, g, or t
  misc_feature (295)..(295): n is a, c, g, or t
  misc_feature (352)..(352): n is a, c, g, or t
  misc_feature (362)..(362): n is a, c, g, or t
  misc_feature (368)..(368): n is a, c, g, or t
  misc_feature (394)..(394): n is a, c, g, or t
  misc_feature (411)..(411): n is a, c, g, or t
  misc_feature (414)..(415): n is a, c, g, or t
tctgcggctggctgaattgctgtgtgaccttgagcaaggccttccccctctgagtcccagcctccctcccctaggggcagagaaggcaggtgtagcctctcatccccgcgacccggctgcctggctgggctaccctgggaagttgtttgatcccccgggctcagttatcttatctgcaaaattgttatgcccatgtagattcagcagacancaccgggtcttcggatacatctttcttgtctttctgccaccctctgcnccgtttcttggctccgaggggggagtatgncactgngactggctatttgagtcatccgaggaggagatggagcctcgacattgtccctctgcnccgggcaggnccaggnccggcttctgatatgggttctccccnccctgccctgggaaganggnngcctctggccataggttggctttgagtgcccatggtgcaggagtgagcctcctgtcaacagaga

SEQ ID NO: 11696 - DNA, 208 bp, Canis familiaris
ccaaaatcaaaatggctgtcgccttagcgaagatcaaccgaggaacattaattcaaggattaaacagcatatctagatcttccaaatcagtggccaaacttctgcagcctcagcttgcttgtagacttctagagctaaggggcatatctcatcgtttgctgagggaagttaatgcaccaaagcaacccctatataatgtgcaggtcag

SEQ ID NO: 11697 - DNA, 589 bp, Canis familiaris
agtaggacaagcattgccctggcctgcaagcttgccaagcactaggaacccaaggaagaactcgtcatgccaatcaaacctgttgggtggatatgtgggcaggtgttgaagaacttttctggaagaatcgaggggatccagaaagtaatcatggaccttatagatgagtttaaagatgaattccctaccatcctaagattatcacagtctaatcaggtcagaaggggttctttgtttgaaatcatttcttttccagcaaagactgctttaattagcataatgtatgcttcatatgcagcactcatttatttggtaatctgtgttaatgctgtgctggagaagataaagaaaattttccaagaagaagaaaccataaggcaaaacagaaaagagaatgaaaatcttagaaaagccttttctgagcctgtgctttctgagcctacatttcctgaaggtgaaatcaaagcaaaaccttacaggtcattaccagagaaaccagacagtatttcggatcgccccaaacttcctgctaataagttgagtaataagatccaagttttacattctgtgtttgaccaatcagctgaaa

SEQ ID NO: 11698 - DNA, 137 bp, Canis familiaris
  misc_feature (26)..(26): n is a, c, g, or t
  misc_feature (33)..(34): n is a, c, g, or t
  misc_feature (36)..(36): n is a, c, g, or t
  misc_feature (48)..(48): n is a, c, g, or t
  misc_feature (50)..(50): n is a, c, g, or t
  misc_feature (54)..(54): n is a, c, g, or t
  misc_feature (68)..(68): n is a, c, g, or t
  misc_feature (108)..(108): n is a, c, g, or t
agaatgagttcaaagaatcctcaaancatgtcnncntctcaaatgtancnctgnctttccaaggtgancgatgttttcgtactaccttgacagaagaagaaagtgagncaagttcatccaaagggttgagtgctaga

SEQ ID NO: 11699 - DNA, 474 bp, Canis familiaris
  misc_feature (36)..(36): n is a, c, g, or t
  misc_feature (40)..(40): n is a, c, g, or t
  misc_feature (225)..(225): n is a, c, g, or t
  misc_feature (278)..(278): n is a, c, g, or t
  misc_feature (395)..(395): n is a, c, g, or t
  misc_feature (398)..(398): n is a, c, g, or t
  misc_feature (438)..(438): n is a, c, g, or t
ggcactccacaaatgttcactacatacaagattctncctncttcagttaagtatctataagcagctaaaaacagatttctttcccgtcatcaatttcctaggagacaactccgaaaaaatttcctcagggttccttacagtaactgagagggctgctgtgatgataaagggataacgtatacagagtgctggcacaggatctggcacacgatgctcagggtaagnctccattcctctgatacctggacccaaactggacacaagaaaactcatccccnccgccaccaccttcatcatcaccatcatcatcatcatcatcatcttcttcatcttcatcactactgtcgccagaaagtgcgaggaagaggaaggagaaaggattgtcgtacatactnccncaacaaaagcaaaaaaggtcatcagggaacaaaggaaaancaagaggtggaaaagcttttgtaactgctgtctctt

SEQ ID NO: 11700 - DNA, 232 bp, Canis familiaris
gaaccagtggattgcttgctgaacaacatcccaaacttctatttgacctgatgcccatcatatggataaaaccaaccaaaaagtctgacattgtgaagtcaaatgcctatgtctgtcccctctacaagacaagtgaacgtaaaggaactctttccaccacaggacattctactaactttgtcattgcaatgctgttaaagacggaccaacccactcaacattggatcaagcg

SEQ ID NO: 11701 - DNA, 284 bp, Canis familiaris
tgctatgggcgagattggttttgaccagttctacatgttggtctgcatcctgctggcacaacagaaccacttggaagagcaatttatcttccgtcattcccggcctgtttttgagctgcttgacctggatggggagctgagaattggtgcagaccacttccacatgtacaactttctcttcaatattaaaaaacaggaactcagagagctctaccatgactttgacatcacaggtgatcgtcgtcttaattacaaggaatttaagctgtttactatcttcacca

SEQ ID NO: 11702 - DNA, 62 bp, Canis familiaris
gctccactcaaaaagaaaaggccacatcgctttattttgagctcaaaacttttttaggaata

SEQ ID NO: 11703 - DNA, 567 bp, Canis familiaris
gaaggtaatacagctcttaggaaagattgaggcttccagttctgagcaaatctcaaatttaaagatggtccagggagattatcgccatgaaatgaaccttttggagttcaaatttaatttactttcaaataatctatgtgaggaaattgagaaccatcaaaaatggacaaaaaaccagttcgtcagctatgaaaaagaccaccttggccacataaatcaatgtctgaagctcctccaggagaaactggaaaagtccgaaaacaaaatgaaagaaaaactattgcagctttcaagcaaattagagaatttcattaacacagagaaacaggaagcagaactaagcaaagtaaagcatatagaaaataagctgtccaaaaagatgcagcaactggaaaagcacatttggggtgaattagagaaaatgcagaatgaatatcaatcaggatttaaatcaattcacgactctctcaactccctccaacaaatacagaaaacaaagatggatttagagaaatataaagtacaaaaagacctaaagaaattacagcgtaagatagtggaactcca

SEQ ID NO: 11704 - DNA, 84 bp, Canis familiaris
gaattggcccaataatgaaagaggaaaaagagaagaaaagacgccggctggagaacataaactccttgaaaggaatgggctact

SEQ ID NO: 11705 - DNA, 297 bp, Canis familiaris
cggcccataggaatgcatggagagaactaccgcctggaaatcttcgagggctgcaactttactggccagtgcctggagtttcaggatgactgcccctgcctgccaagtcagggctggtccaagaactgcgtcaatgccatcaaggtgtacggggatggagcgtgggtgctgtacgaggagcccaactaccgcggccgcatgtacctggtggagcggggtgacttccgcagcttctcggactgggaggcccacagcgcccgcatccagtcactccgcagggtggtcaacttcttctag

SEQ ID NO: 11706 - DNA, 201 bp, Canis familiaris
atgaagctcctttggctgactgtggctgcactgctgctcctgacccagctcactccaggtggcacccaaagatgctggaatcttcacggcaaatgccgccagaaatgctccaggagagaaaggacctatgtttactgcacaaataataaactgtgctgtgtgaagcccaagttccagccgagagaaaatctatggccattt

SEQ ID NO: 11707 - DNA, 501 bp, Canis familiaris
  misc_feature (41)..(41): n is a, c, g, or t
  misc_feature (72)..(72): n is a, c, g, or t
  misc_feature (88)..(88): n is a, c, g, or t
  misc_feature (98)..(98): n is a, c, g, or t
  misc_feature (130)..(130): n is a, c, g, or t
  misc_feature (180)..(181): n is a, c, g, or t
aaatgaggctccatgtgggctgagtagctcacccagagttnccccgacagtgagcagcagagccagaattcncacccaaggaaagccncctccaaggnccgagcactttctggtgtgggacgcacaatcngggcaagtggtggaaagtgtggagggtcacaagtcacggatgctggtggnngcatcgccgtcatggtcactgccaccccgggcagagtggaggaggtcaggtgaacaggtgtccagactggtgcaagtgaatggtccagacccgagcaacaatagcttccctccctctccctgcgaagcgtcaactgtgactaatgtcatagtgtgaaatgtctggattttctttctttttgagtgatgtgcagatatttctaaaccagttttgatggggattcatttctagtggctatagaaatactcatagaaacactcccattagacttatgcctctgttaatctcacatgtcgatcctcacggcagaagttacgatg

SEQ ID NO: 11708 - DNA, 305 bp, Canis familiaris
  misc_feature (36)..(37): n is a, c, g, or t
  misc_feature (139)..(140): n is a, c, g, or t
  misc_feature (150)..(150): n is a, c, g, or t
  misc_feature (242)..(242): n is a, c, g, or t
  misc_feature (249)..(249): n is a, c, g, or t
  misc_feature (253)..(253): n is a, c, g, or t
  misc_feature (258)..(258): n is a, c, g, or t
  misc_feature (266)..(266): n is a, c, g, or t
ggatattttcccaacgagctgcgagccatcttccgnnagcaggtgcatctcatccagaatgccatcatcgaaagccgcattgactgtcagcgccactgtggcatcttccagtacgaaaccatctcctgcatcaactgcnntgactcgcantgtcgtctgctttggctacaactgcgagtcgtcagcacagtgggaaacagccgtacagggcctcctcctttacataaataagtggcacaaancaggacnaccnaaacnaagaaccnactccagcctttctgatatcaccaagctttacatgtctt

SEQ ID NO: 11709 - DNA, 347 bp, Canis familiaris
  misc_feature (206)..(206): n is a, c, g, or t
gcaagcacttcaccgggcggaagctggaggtctatggggactgtgacaacttccaggacagaggcttcatgaatcgggtgaactccatccgcgtggagagcggcgcctgggtctgttttgatcaccctgacttccggggccagcagtttatcctggagcatggagactaccctgacttcctccgctggaatggccacaacgaccanatggcctcctgccggcccataggaatgcatggagagaactaccgcctggaaatcttcgagggctgcaactttactggccagtgcctggagtttcaggatgactgcccctgcctgccaagtcagggctggtccaagaactgc

SEQ ID NO: 11710 - DNA, 270 bp, Canis familiaris
  misc_feature (40)..(40): n is a, c, g, or t
  misc_feature (61)..(61): n is a, c, g, or t
  misc_feature (77)..(77): n is a, c, g, or t
actccagcctttctgatatcaccaagctttacatgtcttngagcccccacacctggccaancctgactctagaaaantgcttccgagtgcctgacccagcactgatgaccaccgggtttgccagagcggccctagccttgaggtggagccagactcagctggactgtcccagcctgaccccatggagcaggcctgccgctgccttgagcccctgcactcccatcagagcctggggctgggccgggagcagtgtgcggctttgtcgggcgg

SEQ ID NO: 11711 - DNA, 431 bp, Canis familiaris
ggttgctgggacagcctctttgaaaaggtataaagaaagaacaagagaaaaaccatcaaaagaaaacagagacaggtttaagaaaccaacagattatttaaggtttttcatagggaatttcctaaagactgctctgtctcgacggatcctggtcacctacctcagccgtagggtgacagttgaagccatagacatttggttatttatggagataattccctaaatatttgatattcttataagggttttgttttaaagcatcttaatcttttcagacaccgacaccgaatgcctttaaatggctacagatgcttaacattcaatattttcatcagtttagccggagcctattttcatcctgttctaataactttcagattccatagccagtaagatcattccaacttgcagcttaagacccattttcctta

SEQ ID NO: 11712 - DNA, 526 bp, Canis familiaris
  misc_feature (29)..(29): n is a, c, g, or t
  misc_feature (38)..(38): n is a, c, g, or t
aaggttatcaggacaccccatgggagagnctttgatgnctctttggaaagatgtgatgagtacttaagctcaaggtcatgtagcaagccccagcattcagcaaggaccttactagtccattcagcaccttcaacaatgccgaagcattctccaagccctgtgttaaatagagcttctctcagggaaagattccattctgattggtgttcaccttcaaactgcgatgagatccatgaccgggatgagagagacccagagaaggaagacgaactggaactgaaaagaggtcttttatacagagactctgcctacgacagtgacccagagtatagctcatttcagcggccacgtggcactctccatttggatgatggtgaatactggtccaacagggcagcctcttataaaggaaaatcccaccgacccgtctttgagaacagcatggacaagatatacaggaacttatacaaaaaggcctgtagttccgtttctcatacacaggaaagcttctgataccatccatgat

SEQ ID NO: 11713 - DNA, 462 bp, Canis familiaris
gagtggtacctacccagctgagagagctgctgttctacttgacattctaatgtccaaagtcaaggacttcttcagaacatcttgatacaacatcatggagctttgtccatgaaatcacatcaagaatacaaagcattgcttatcagcctgggtcgagtcactggtggtctgcggaagaacagtgtgtgctatggtaggggaataattgtcatcacgaaccttcctgggactttggcaaaatgccatcagtctttcgcagctaaatgttagctccccccaccaccactggtccaccaaccgacccagataacatgctcatgcagcgtgcatgaaaatactagaaataactcccttttaagctatcccgtattatacaaaatttgactcttgaaagtaactgaatattttatttacctctatgatctgatctgagatataaacctattgtgtgtgcttcatgaa

SEQ ID NO: 11714 - DNA, 193 bp, Canis familiaris
gtggcgaaattcacatactcgctgtatgtggcagatgacactgagccagaggagaaacctgtatgctaccctaaggatgcaggacaccatgggacaggagttggcactagccaacaagcagctactgatggtccgtcaagcggccctgcaccagctgtttgcaaaggagcatcggcagtacaagcaggagcta

SEQ ID NO: 11715 - DNA, 212 bp, Canis familiaris
cccactacataaagaaataccaggaaattctgaggcagatggaaaaggaaaaagaggtgctgcttcttgaaaaagaagtattcaaagcccagaacaactcttcccaaatagtgaaacctggttcaattctggtagagaccatccaaagcaacatggagaagaccatcattaagaaacagaagagaatcttttggtacagacatttcaggtgt

SEQ ID NO: 11716 - DNA, 564 bp, Canis familiaris
  misc_feature (512)..(512): n is a, c, g, or t
agagtggccaagcttgtattccaaaggttgaatgaagactttgtgaggaaacccgactatgcgctgagttctgtgggggcctccatcgaccttgagaagacatcacacgattatgaggatgcgaacactgcctatttctggaatcgcttcagcttctggaattacgcacggccgccaaccgttatcctggagccagatgtattcccggggaattgctgggcttttgagggcgaccagggccaggtggtgatccggctaccgggtcgtgtgcaactaagcgacatcaccctgcagcacccaccacccagtgtggcacacaccggaggagccaaaagcgccccccgcgacttcgcagtctacggcctccaggttgatgacgagactgaagttttcttggggaaattcaccttcaatgtggagaaatcggagattcagactttccatctacagaatgatcccccagctgcctttcccaaggtgaagatccagattctaagcaactggggccaccntcgtttcacatgcttgtatcgggtccgagcccatggcatgcgaacttcggag

SEQ ID NO: 11717 - DNA, 272 bp, Canis familiaris
  misc_feature (226)..(226): n is a, c, g, or t
gatacctgcctctaccgaatttgttcaacagccattcctagagctgctaatagaagaagacaggaagtctgacacattcaagaaatttcgacaagatcaaatgggagctatctggaatactgatctgtcgacttcaagctacccaataacagagaagacatcaatacatttgctctgggcccagctgggtgggtacccagatattcctatgctactccaattagangttcaatctaccttcagaaaatctcttgcatccattaaatcacggt

SEQ ID NO: 11718 - DNA, 498 bp, Canis familiaris
aagcgagatggctatggcaccctcagcttttctgaccaagagatgggaaagcacaggaaagtatactctggctggtggaaaggcgataaaaaatcgggctatgggattcagttttttggacccaaggagtattacgagggtgagtggtgtggtaaccagcgcagcggatggggccgcatgtactacagcaacggtgacctctacgaaggccagtggttgaatgacaagccgcatggggagggcatgttgcgccagaagaacgggaaccgctacgagggctactggcagagaggcatgaagaatgggtcgggccgttttttccacctggaccatggtcaactgtttgaaggcttctgggtggacgacgtggccaagtgtggcacaatgattgactttggtcgcgatgaggcccctgagcccacccagttccccattcctgagatcaaaattctagaccctgatggtgtgctggaggaagccttggccatgttcaagaag

SEQ ID NO: 11719 - DNA, 163 bp, Canis familiaris
cccaagctgccaggaaaggaggagaaaaagaagcttcagcctctaaatcagcatgatgcagcctgctattaggaagaaaaactgcctgcaaataatagaacaaaagtaaggtcctcataacccataagtgcttctcacattacctggctaggacagaggtcct

SEQ ID NO: 11720 - DNA, 560 bp, Canis familiaris
  misc_feature (101)..(101): n is a, c, g, or t
  misc_feature (139)..(139): n is a, c, g, or t
  misc_feature (202)..(202): n is a, c, g, or t
  misc_feature (213)..(213): n is a, c, g, or t
  misc_feature (222)..(222): n is a, c, g, or t
  misc_feature (374)..(374): n is a, c, g, or t
tagcgtcactgttcttctgtgtgcgggtgtttgcgcactcgtagtgggcgttttacttgcagctttgaaggatgtcgttgcctacatatttaccagtgacnaaagatattatttaccttgtgagccaagtgatgcctantttttgctccctttcatctatttgatgcacttgcagtctctggtctggattgatagtctgtgnttttctttcangcccttttnctatttggtgctcatctggaagacaaactgggagagagttgccgagcaggcacaggtccgagctgggctgaaggggatcatcagagagaccacgccgtcaccagcagatctgcctgtcttggagaaagaagtaaccgatggagtcattttancctgatatcatcacacccgagagccagaccctccaattaatggggatagagtgaaactgagaagcattcagtaaaagtatgaagggaacagtccagagagacacatgctctttaaaaagactgagaccttatcattcaactatagaacacttccttcccccacaccttagcatcacatccatggag

SEQ ID NO: 11721 - DNA, 388 bp, Canis familiaris
  misc_feature (238)..(238): n is a, c, g, or t
  misc_feature (268)..(268): n is a, c, g, or t
  misc_feature (276)..(276): n is a, c, g, or t
  misc_feature (286)..(286): n is a, c, g, or t
  misc_feature (304)..(304): n is a, c, g, or t
cgagtcgcacagatccagcaactgaaaaacacaacgcaaagtgacaggttcttcttcaggaagttggatgaactctgctggacaagtcttcaggccttccctcttcctctgtccataccttaagtcaccaaacacaattcaaatcccttcagaagagcaacttttgactgtcaaataatggtcagtgaaaattaccacaatcaaggaattcaatcttcagctactatagactttcaanctcactgaattctcagaggctgtgaccttncttctttnccatttgttnacctttcctaaagagtcnccaacccctgaagacaaagggtcaggatggtaggtctgtatcaggtaatctgccaccttagctccaaatgcttggctagtggta

SEQ ID NO: 11722 - DNA, 50 bp, Canis familiaris
agccaccgctactgaggagtggccttgtattaaatcactttgcctgctgc

SEQ ID NO: 11723 - DNA, 245 bp, Canis familiaris
  misc_feature (186)..(186): n is a, c, g, or t
  misc_feature (206)..(206): n is a, c, g, or t
  misc_feature (209)..(209): n is a, c, g, or t
  misc_feature (211)..(211): n is a, c, g, or t
ccacctattgtatgacctttgctgaagacaagctcttcccagaagttaaagtgaccaccataatccagtcaaaagatgcagtgcttgcaggaaagtctcagaaatgactggactccatggtagcacctaactgatgctcgtctaggaccatgaagtagaggacagagtatttctcaaaggaagggnaattgaataaacaacagganatntncactcatccaccatcctcaaaatctcctttgttt

SEQ ID NO: 11724 - DNA, 557 bp, Canis familiaris
gtatcctgatatcctgaattttgtggatgatttggaacatttagacaaagctagtaaagtctctgtagaaacgctggaaaagaatttgaagcagatgggaaggcagcttcaacagcttgagaaagatttggaaacctttccccctcctgaggacttgcatgataagtttgtgacaaagatctttgttatcagcgcaaaagaacaatatgagaaacttctaaagttacatgaaaatatggagaagttataccagagtgtgatgggatactatgccattgacgtgaagaagatgtccgtggaagacttttttaatgacttgaataatttcagaaccacattcatgcaagcaagaaaggagaacatcaaaaaaagagaagcagaggaaagggaaaaacgtgcccaaatagccaaagaattggcagagaaagaaagacttgaacgccaacaaaagaaaaagcgcttgttagaaatgaagactgagggtgatgagacaggagtgatggatagtctgctggaggctttgcagtcgggcgctgccttccgcgaccgaagaaaaa

SEQ ID NO: 11725 - DNA, 173 bp, Canis familiaris
atctaaatcattccttcaagatgaatcctttaaaccaagtgttcaggcgccccaatattaagttgtattccaacaacttattgcttcattattggaagggtgtcagacacacagtacctgcattattgctcgatcttgcactcaggttgacaggtcagaaaccgtggatgatg

SEQ ID NO: 11726 - DNA, 350 bp, Canis familiaris
  misc_feature (29)..(29): n is a, c, g, or t
  misc_feature (101)..(101): n is a, c, g, or t
tggttccgtcagacctcagagaagaactncaactacaagttcaacgtcccaagccaaagtctatactgaggacagaagtgtctcctacaggcctggacccntgagcaggcctggtactgagcaatgcttttctttgtgcttcccacaaagaaaaggggaagcacaaaggaatgggggcctccattcctcccaaggccccaaaggctggggctctgcacagagggtagggggttccccctggggctataagaccaagctgtggcccctcctgcaaggggttactgtaagtagagcctcagagtaacagccatttcattctgcttctgtgattatgacagcatgagaccatg

SEQ ID NO: 11727 - DNA, 349 bp, Canis familiaris
tatttgccattctccaatcttctgattgcttgagtccttctacatggcctatggctgtagttgtactgcgggttacagtgagctggaatttcgctgtggatttttatggccaaaccacccttgacttcccacttagctttcccattggaaaagagatgctaataaggaaacacttatcgtatgtattcccgctaggactcacaactgccaccctgtcactaataagtgccaccatgttcttctgtgaaacatctttcacaaaacaatggaatcaagtgaaacccatggctgtggggaaccatcaaaaatgaaaggtctgaacaaaggatctactctttggaatggccac

SEQ ID NO: 11728 - DNA, 564 bp, Canis familiaris
  misc_feature (83)..(83): n is a, c, g, or t
gatcttctggaagttctcggttgttttgaaactagtaagaaatatgaagtcatgaacagccaaggacagagaatttattttgncgaagacagaagtaattgtttcctcagatacctctgtggaccttcaagatcttttaccattacaatttatgataacataggccgtgatgtcataactgtgcataaagctctaagatgtagctgttgctggagaaactgctacctacaaaagctaaaagttgaggctcctcctggtgaaaaaattggatatgtgtaccaatactttcacccattgtggccaatgtttaaaattaaaaatgcaaataaggaggatataatgaaaatcagaggaccatgtgtggtttccagctgtctcacggatctaaattttaatttattgtctctggatgaagaaatagttattggtaagatttcaaatacatgggctggatttattagggaactatctaccaatgctgataaatttggaatccagtttccacttgatcttgatgttaagataaaagcactgatgcttggagcaagtttcctcattgactac

SEQ ID NO: 11729 - DNA, 219 bp, Canis familiaris
tgtgttggcggctgcaggccttcggggcctggttcggctgctgcacgtgcgagctggcttctgctgtggggtcatccgggcccacaagaaggccattgccaccctctgcttcagccccacccacgagacccatctcttcaccgcctcctatgacaagcggatcatcctctgggacctcggggtgcccaaccacgattacgaattccaggccagccagct

SEQ ID NO: 11730 - DNA, 537 bp, Canis familiaris
  misc_feature (84)..(84): n is a, c, g, or t
  misc_feature (119)..(119): n is a, c, g, or t
  misc_feature (320)..(320): n is a, c, g, or t
  misc_feature (325)..(325): n is a, c, g, or t
  misc_feature (375)..(375): n is a, c, g, or t
  misc_feature (385)..(385): n is a, c, g, or t
  misc_feature (419)..(420): n is a, c, g, or t
  misc_feature (459)..(459): n is a, c, g, or t
  misc_feature (470)..(470): n is a, c, g, or t
  misc_feature (497)..(497): n is a, c, g, or t
tgtcctgctggcacgaagccaagctccaaccgataaacatgacttcagatgaaattctagtccaagagatgttggatccaaatnaatcatcaaaggctgcaaagcaaaggacagcatcnccattatcaacaaaatttttcaaggacaaaaataccatcatggatgagacttttcaagttggtgctcctcagagttatcacggactctcagacaattcacaattctctattggcaatgaggacaaaattttcaataatgaacacagcattgatgagagttaccagatcggcagtcctgagggttttggaaagaagaattcncaaancgatcaatataaaaaactgtcaattctggacaaaatccttcaaaacattnggaaaatctnagggcactctttgcagtaaatggaagaggagggnnaggctctgaagaggtgcagagggcaatcagcacgggccncctgctctgangggagccccctccacaggaaatccagncttcgtgagaccccatagccccaccctcaggaataaagtg

SEQ ID NO: 11731 - DNA, 464 bp, Canis familiaris
  misc_feature (30)..(30): n is a, c, g, or t
  misc_feature (32)..(32): n is a, c, g, or t
  misc_feature (54)..(54): n is a, c, g, or t
tttggcatgggcaaggtgacctataagccncnaacttctagcagagttacagancaaccgactccaagcacctcagggagaaaagagaagaccccctttcaactcgggtccagagacagtgacatggtagccaagacaattatgaaagctaaaagatatcctcaagggagtttaagagaagacacctcttccagagttcccatccctttaattaattctaagaaaaccaaaggatcaatcctattcagccattatcacaagctgaatgaaaagctgaatcaaaatgaacccaagcagtcccaagagagtgtagaaaaacccaccacttcagatgaagagccgggcagccagaacttcagagtggagccagaggcctcaaatatctgtgaaatctccaaagtctagccacttcgaaatggcaactacttagagaccaaactacacgaacagggtacatgcatggt

SEQ ID NO: 11732 - DNA, 214 bp, Canis familiaris
  misc_feature (74)..(74): n is a, c, g, or t
  misc_feature (88)..(88): n is a, c, g, or t
  misc_feature (117)..(117): n is a, c, g, or t
gagacccaacatagaactctgccgggacatggctcagctacgtcttgttaatgaagtgtatgaggtggatgacnccatccagaccttncagcagcgcctgagggaagcggaggacanccctgcagtcgctggtccacaccaaagccacactggagcatgacctggctgtcaaagccaattccctgtacattgaccaggaaaaatgcatgagcat

SEQ ID NO: 11733 - DNA, 84 bp, Canis familiaris
tgggcttctgttagggaccccaccaggaactggaaaagtggaaccaaagccctgtggcagcaatttaaactgagtgctaatata

SEQ ID NO: 11734 - DNA, 180 bp, Canis familiaris
ctcggatgtcccatgagccaatgcactggtgcctgaacctgctgctgacggacaagatgaagccggagtgaggaaggaggctgagggcgtgggaggaggggagaaggtggccgctctggactatctacacttgaagatgtgttccctccacgatcaactcagcaacctgccacttgaggg

SEQ ID NO: 11735 - DNA, 412 bp, Canis familiaris
aagatgctgacttctggccatgtttcatggtagcacatgtatccaacttgcaagtgagagaaaaaggttccaccttggatgatgcctaaactctccctctgccccactccacctcactctcactcaaaagagcatcaatggaaatatcaccatcagcaccaaggacagcagccctggtcgccataagtgtccgtgatcattgaaaactggatctattgatgatacacatttcaggagctcatttgaattcagattagaaatccttagagcctagctcaaagttgtaatcatctgctctacagtactacttatcttattcatattattatctttggagtaaatcattggcaaaaccgaggatcagaaactaccaggtcttgaaagaccataagtcttcaatctagcctattct

SEQ ID NO: 11736 - DNA, 539 bp, Canis familiaris
aggcaaactctcactatataggcaacaggcatccattatatctcgtaaaaaagaagccaaagctgaggaacttcaggaagcaaaggagaagctagccaacctagagagagaagtgtcagtgaagacaaatcagacccgtgaatttgatggcaccgaagttttgaagggagatgatttcaaacgatatgtcagtaaacttcgaagcaagagtacagttttcaaaaagaagcatcaaataatagctggatttaaagctgaattcggtctcttacagaggacagaagaacttcttaagcaacgtcatgaaaatattcaacatcaactgcaaaccattgaagataaaaagggtatatctggatatagttacacccaggaagaactagaacgagtgtctgcactgaagaccgaagttgatgagatgaaaggccgaacactcgacgacatgtctgaaatggtaaaaaaactgaattcattggtatctgaaaagaagtcagctctagccccagttataaaagaactacgacagttgcgtcagaaat

SEQ ID NO: 11737 - DNA, 522 bp, Canis familiaris
  misc_feature (221)..(221): n is a, c, g, or t
aagtttctgacttcatttccggatggaacaacgcaaatattctacccatctggaaacctagccatcatccgagtgcccaacaaaatcagtggtttcacttgtatagtccaagaagacatgcccactgaccctgcaatcttggcattgctagattcttctggcagaagttcctgctatcatcccaatggaaatgtctgggtatacatcaatatcttgggagntcagtattcagatcaagctggcaacagattaagggcttggaattggtccagttctgttgcttcctcaccctttgtttcatttaaacctgtctttctggccttgaaccattacattggagttcgcatcttagaacaagacaagatttcagtcacttttctagcaatgggccaacaggcaagaatcagtgttgggaccaaagtgaagctacctaaccctgaggagattccagttctccgatacctgaatgaggatgacctgctgctactggccaatttaatcaagattcgacgcctgtttcat

SEQ ID NO: 11738 - DNA, 324 bp, Canis familiaris
  misc_feature (246)..(247): n is a, c, g, or t
  misc_feature (263)..(263): n is a, c, g, or t
ttccaaggctgtggcgtctgagtttgaagaatccttgaaagactctccacccacttctatggtcgtctcagaaagcagcgaaactgtttcatccttggattcattcctcataacaaaattcatggaaaacatcagtgaggaagaacaaatcagtatcatcaaggtggcctcagaactagtgacagcgattgggcggtggagaatattgaggatgaaattcctgaagaggaagaaacctcaggtccnnaagcacaatgaggcgngaatcaacaggagggggtccctggtgcagttggagtatacctgctactttgtagactgagt

SEQ ID NO: 11739 - DNA, 538 bp, Canis familiaris
gtctcaatggtcagcatagcccaagcccccctgaaatcgaaagatgcacttatccattttttcctggaacaaagcttactccaattagcatgtattctttaaaatccaatcatttcaattctgcagtaatgcatttggattattactgcaacaaaaataattgggcaccaccagaatattatttatattcaacaacaagtcaagatgggaaagtactcttggtatataaaattgttattcctgctattgcaaatggatcccagagttactttatgccagacaaactctgtactacattagaagatgcaaaggaactggcagcccagtttacattacttcatttggactacactttccgtcgcagctcaataaatagtctttcccctgttagtgctactctctcttctgggactcccagcgtgcttccttatacttcaaggccttattcttatccaagctatcccttgtcaccaacaatatcacttactaatggcagccatgttggacagcgactatatatctccaatcaggcctcatt

SEQ ID NO: 11740 - DNA, 295 bp, Canis familiaris
aaacttgcctgtctggcaaaacccactgtgaccatcagtactcaggaagattggatcactataaaaaccaaaagcatctttaaaaataataagatctcctttaaactgggggaagagtttgaggaaaccacaccaggtggccataaaaccaagagtgtggtaaccttagataatgactctttgattcaagttcaggattgggatggcaaagagaacaccataaggagaaagttggtggatggaaaaatggtggtggaaagtgctgtgaacaatgttacctgtactcggacgtatg

SEQ ID NO: 11741 - DNA, 136 bp, Canis familiaris
cgcggaatcgaggagaatcctaaggaggaattggacagctgagccgccatcacgcatcgcctgccttgctatgcttgggaagtgtgaacattatttaaggaaattcctgcagaccgattacgttgatatatacatt

SEQ ID NO: 11742 - DNA, 370 bp, Canis familiaris
aagaaaaccagccatccactgtcttctttctaccacttggaggattcgtttcctttcttcagctactcatcacatatcatcgtgacacagagaaaacattctgggctaggccagggtggatggtcccaaacatacacgcaaggacaaaaaagggtcgccatacattcatggccaacaaacagctttagaaagggtccagatgttggggagaaagggttaaaggaattaggcaagtcttctgttgcggccatccaacccatgtactatgactattatggtggggatgccagggatggtggtgggcctatttcaggtcagaacaggttacatcagccccaagaaattatcttgtttttctttgtgctggttt

SEQ ID NO: 11743 - DNA, 448 bp, Canis familiaris
  misc_feature (56)..(56): n is a, c, g, or t
catcttcccgggaaatgacggaccaaggagcctgtctccatgtacaggaccagtanccaagcttacgggagcagggcccccaccgtgcatgagatgccgaaagtattttatccaaattcaagtaagttttccagacaacttgcagcaggtggaatgttccggaacaacactttcaatgtctacatggagaagagcatcgtgacaggtcccgacaactacatcacctcctatgaccggttcaacttccaccccagttacaacatcaataggccatctatctgtgattgagggacctcgggatgccagtaggggtgacctcaagtgtgacccctaatctctcatcatttgcccgattgtaaaagtacagacttcactgctttctctggaaacattttttctctctctagattagaaaaatatgcagatggcgctgtaatgtcctatttgc

SEQ ID NO: 11744 - DNA, 560 bp, Canis familiaris
  misc_feature (26)..(26): n is a, c, g, or t
  misc_feature (29)..(29): n is a, c, g, or t
  misc_feature (71)..(71): n is a, c, g, or t
  misc_feature (141)..(141): n is a, c, g, or t
  misc_feature (255)..(255): n is a, c, g, or t
gatgtctgatgatattgcctggtacncancccaggggggtgtgcaaggtagatctctacagcccaacaggncagcaagatcaggaccggaaaagtgatatgctttgttgatgtgccaccctgaatgtggaagataaagatnccaaggatgctgctggttccagttcagaaggtgacttaaccttgggaaatctggaagaaaaagagattattgtgatcaaggatactgagaagcaagaccagtctaagcttcctnaagtttcagctaaggcggcagagaaggggtacagtgtaggggatcttcttcaagaggtcatgaagtttgccaaggaacgacaactggatgaagccgtgggaaacatggctaggaaacaactgctagactggttgctcactaacctgtgagctaacaactcctttgactcctctccatttacccccctagcagcattccatcccagcctgaacaccccacccatcaggccagtgaactgcacatcacacaattgtatttcccaatacatctgagcagtttgtgcaaatacagggtgtccaaaagct

SEQ ID NO: 11745 - DNA, 565 bp, Canis familiaris
  misc_feature (204)..(204): n is a, c, g, or t
  misc_feature (402)..(402): n is a, c, g, or t
tgcagtgcctgtgccataggtacatcctctacaggcgcttccagcacctccgacaggaagtgatcaaccacatacaagtcatccgagaaacagggactacctacaaggcccagaacctctatgtcttcctcgaaaacatcgacaatctgcagaacttctggctgcaggcctggacagacaagcagaaggaagtggaggagaagnaccgagagtgcctgagcagcatggtgaccatgttccccaagctccagctggagtggaatgttcatctgcacactcctgtggtcaccaacccaaagtcaaggaaaagcaaaccacccccgtcctatctccagcacacgcactcctgtaatccctcctgcaagcagtccccagagcacttcccatccaagcactgggaangtgtgcccctgcgcatggcccgccatcaggagaaccagatggaggccgtctggaagactgatgtggcctcctccagtcacccgatagaaaagaagactccccccagcctgctctgggaccagctaggagggtacccagatattccccggctgttggccttgga

SEQ ID NO: 11746 - DNA, 584 bp, Canis familiaris
  misc_feature (35)..(35): n is a, c, g, or t
aatggtggtgtgtcctctgatagatgtcattgacnctatgacccttgaataccagtcctctcctgttgtaaggggtgctttcaactggcatctagattttaagtgggatagtgtttattcttatgagatggatggaccagaaggacccactagacccatccggtcacctgcaatggctggaggaatttttgctataaacaggcattattttaatgagattggacaatacgacaaaggcatggatctctggggagcagaaaatttggaactttcactgaggatctggatgtgtggaggccaactctttataatcccctgctcccgagtgggacacatcagtaagcagcgcttttcaaaccaacctgagcttgtaaaagccatgacatataataatctcagattggtgcacgtctggctggatgaatacaaggagcagttttttttacatcagcctggtctgaaatctgttgcctatggcaacattagtgagcgtgttgaactaaggaaacgattgggttgcaaatcatttcagtggtatctggataatgtcttcccagaattggagacatctaagggcagcctat

SEQ ID NO: 11747 - DNA, 52 bp, Canis familiaris
acaattgtatttcccaatacatctgagcagtttgtgcaaatacagggtgtcc

SEQ ID NO: 11748 - DNA, 563 bp, Canis familiaris
  misc_feature (30)..(31): n is a, c, g, or t
  misc_feature (80)..(80): n is a, c, g, or t
  misc_feature (136)..(136): n is a, c, g, or t
  misc_feature (140)..(140): n is a, c, g, or t
  misc_feature (146)..(146): n is a, c, g, or t
  misc_feature (150)..(150): n is a, c, g, or t
  misc_feature (160)..(160): n is a, c, g, or t
  misc_feature (167)..(167): n is a, c, g, or t
  misc_feature (181)..(181): n is a, c, g, or t
  misc_feature (248)..(248): n is a, c, g, or t
  misc_feature (275)..(275): n is a, c, g, or t
  misc_feature (361)..(361): n is a, c, g, or t
  misc_feature (392)..(392): n is a, c, g, or t
  misc_feature (398)..(398): n is a, c, g, or t
  misc_feature (437)..(437): n is a, c, g, or t
  misc_feature (467)..(467): n is a, c, g, or t
  misc_feature (492)..(492): n is a, c, g, or t
  misc_feature (538)..(538): n is a, c, g, or t
ataaggcagcgcatgccaggcacagacgtnnagctccgtgcccggcgttacctgcaacaactcagacgcctccatgcagnggagccagaggctggggcttcggcccgagcaaaagaccctgaagcacttccggagnccgncccagncccnactgtggggnctgctgnctcgaatgggcctnaagtgctcgaggccgccctggctgctggggctgagggcttggccccagctgaggtgccagctggggnaggcgaagcccctgcagatagtggtcnctgctctagatcacggctgcgccctggacgagccacgtgcacctgcggccaccccggaggaggagcaggccctggcacctgcaacnggggtccccagagtgccagagccgccaattncctctnggacaactggcttcaacctctgcgcagccccctgacctnctcgggagcccgccccagctcccaccgcanggctcgtcatgcctgcagcccaatngaggcttgcccttcccgtgtcatttcactgtttctatattttgacnttttctttaacctgtggcttatgag

SEQ ID NO: 11749 - DNA, 365 bp, Canis familiaris
gaaagcttacaaggaaatcacataaggcaaccaagtgtgaacaagacaatccaaagggatccccagaagagtcaaaggctaaattacaacagctggaggcttcctgtgcagtccaagagaaagaactagccaaggtcatggaagactatgcatttgtggcccagctctgtgaagatcaggccctctgcataaagaagtaccaggaaactttgaggaaaatagaagaagaactagagattcggttccttgaaagagaagtatcaaaagtcttgagcatgaattctgcaagaagagagtctaatagccaaaataataaagtaagcatttcactctactttcagcttctctcagtgatttttcaatac

SEQ ID NO: 11750 - DNA, 421 bp, Canis familiaris
  misc_feature (26)..(26): n is a, c, g, or t
  misc_feature (34)..(34): n is a, c, g, or t
  misc_feature (36)..(36): n is a, c, g, or t
  misc_feature (47)..(47): n is a, c, g, or t
  misc_feature (57)..(57): n is a, c, g, or t
  misc_feature (64)..(64): n is a, c, g, or t
  misc_feature (103)..(103): n is a, c, g, or t
  misc_feature (137)..(137): n is a, c, g, or t
  misc_feature (140)..(140): n is a, c, g, or t
  misc_feature (157)..(157): n is a, c, g, or t
  misc_feature (367)..(367): n is a, c, g, or t
ggaatccagggattcttctatccatngagctgtnanggagatgtgtnggaccggganagctgtnggggccaggccgcaatcgagaatcccaatctctgtctgngtctacgctgctgctaccgtgatggggtctgctnccnccagcggccagatgaanctatgcggaggaagcatatgtgggcgctgggctggacatgtggaggcctcctcttcctaatctccagcatctgcttgttctggtgggccaagcgccgggacatgctgcaccttccagggttcttaaagggcaaatgtgacctgtcgaggaccgtctctctgttatccaaggaccgggggactctgagtgataaaaagacatctgcgggcnagcgtgccaacctcccttcctacggaggggaacgcggatgtgtcaggagccact

SEQ ID NO: 11751 - DNA, 443 bp, Canis familiaris
  misc_feature (127)..(127): n is a, c, g, or t
  misc_feature (129)..(130): n is a, c, g, or t
aaagcaagtgaccagatggctcccccaggggaagccacttaggacatctgcttcttggccatgaccttctaggactcaccatccccagaatggaaacattttctgcgtaggattaaggacagtttangnnaagcgtgcgccacccttagactggtgggctctcctgaacctcacacatacattatcgaggctggcaagaggggcccccaaaagcttggatcagccttctaggccacaaagcagcatgccattagaatcaggagactaaaccaacgccagccagaggatcccaaaggtcatgttcagatgtgtaagaagaaaaccttaattgtacagtggagcacagaggctctacaggagacatcactgagaagccatgctgtccccttgaacttggaacacattctgtctcatcctggttgggctctatacctcattgtaaa

SEQ ID NO: 11752 - DNA, 288 bp, Canis familiaris
  misc_feature (262)..(263): n is a, c, g, or t
aagcccaggcccactgtgcagttcttgatctaaatgtcaccagggagtgttgaattacaggtttgaagccaaaggtttctgctgtcaaataaaaaataagccatttcctattttcttaatgcgtgacatatatacaaagataatgttaattgattaagagcctatgttcagattttgaactttaaaaatattggtaaaataatatatttgggggatttgaattttcatcaacaaaattaaagtgaacattaagcattcaaannatttgtagtttttcaatgacatgag

SEQ ID NO: 11753 - DNA, 589 bp, Canis familiaris
caagagaagcaaccctattacgaagaacaggcccggctaagcaagatccacttagagaagtacccgaactataaatacaaacctcgaccgaaacgcacctgcattgttgatggcaaaaagctccggatcggggagtataagcaactgatgaggtctcggaggcaggagatgaggcagttctttactgtggggcagcagcctcagattccaatcaccacaggaacaggtgttgtgtatcccggtgctatcactatggcaactaccacgccgtccccgcagatggcctctgactgctccagcacctcggccagccccgagcccagcctcccgggcatccagggcgcctacggcctgaagacggacggcgggagcctcgcggccaacgagatgatcaacggagaggatgaaatggagatgtacgacgactatgacgacgatcccaaatcagactatagcagcgaaaacgaggcccccgaagctgtcagtgccaactgaggagtgtgtgtttgccgaatcaaagtacttggacatttcacctcccctctcccccccacaaaaaagttcttaaagagcccgcatgcatttgtgg

SEQ ID NO: 11754 - DNA, 469 bp, Canis familiaris
gacgccatgtcacagatccgcaaaggccatgacaccatgtgtgtggtacttaccagccgccacaagaacctggacaccgtgcgggctgtgtggaccacgggtgacatcaaggcaagcatggactcagctgtggccatcaatgacctgtccgtggtcgtggacctccttaacattgtcaaccagaaagcctccctgtggaagctggatctgtgcaccacggtcttgccgcagatcgagaaacttctgcagagcaagtatgagagctatgtccagaccggctgcacctccctgaagctgatcctgcagcggtttctgcccctgatcactgacatcttagcagcacccccctctgtgggtgtagacatcagccgggaggagaggctacacaagtgccggctctgctacaagcagctcaagagcatcagtggcctcgtcaagagcaagtcaagtttgagtggccgtcatggca

SEQ ID NO: 11755 - DNA, 111 bp, Canis familiaris
  misc_feature (41)..(41): n is a, c, g, or t
aagtcaggcagtgagggtacctcctcacaccagctgcctcntccactcagtattccacggaccaaattgtgccctgggtggcctcagccttttgagtattgaatgataagc

SEQ ID NO: 11756 - DNA, 369 bp, Canis familiaris
  misc_feature (73)..(73): n is a, c, g, or t
atacatcattcagtcctcatcctggtcttggatattgctgtatgaagaggagatgctcagaccttttccatcngccttgcagtcatgaggagacaactattgtaaatgaacagaaatcaaagagaaggcaagactgcacaccctgaaaacttcttatcatctgtaattagctcctcatgaggagagtcctatcagagccaagatatgctgagcccaactcacaccggactcacaccggctcctgcgtggagatcgtggagatccagggagggcagcctcacagatgatgtatttatgagaactgatcgtgctcccgtggaacagagaacactagcacagagagcactgggtccgtgcacagtaggtttt

SEQ ID NO: 11757 - DNA, 357 bp, Canis familiaris
  misc_feature (197)..(197): n is a, c, g, or t
  misc_feature (233)..(233): n is a, c, g, or t
atggcatctgtgtcctttcgagagccaatctctactacagtaggaaaacggatgattgttacaggcccggattatataaaggatcatgtacctaaagttcatcagcacacttcctatataggagaaaagcgcccagtattggaaaagactggagatctcagatatttatggaggcctgcctcaaagagaagcttacnggcaaaatataaatatgagtatgttggtgaaattgnctggggaataccaaagtatgattttatcagcaaatcaaggcttcggactggttttcacatcaagtatggagaaataagtcaagccactattgataaaataagccacagataccaaaatccatgg

SEQ ID NO: 11758 - DNA, 352 bp, Canis familiaris
  misc_feature (70)..(70): n is a, c, g, or t
ccaggagaggtttctctgctcggaaatgttctttaagccttctcttatcaagtccatgcagctgggcctncacacccagacagtgtcctgccttaacaagtgtgacattgccctcaaacgggatctcatggggaacatcctgctgtgcgggggcagcactatgctcagcggtttccctaaccgcctgcagaaggagctgagcagcatgtgtcccaatgacaacccccaggtaaacgtgttgcccgagagagacactgcagtgtggacgggcggctccatcctggcgtcacttcagggcttccaaccactgtgggtccaccgctttgagtatgaggaacatgggcctttcttc

SEQ ID NO: 11759 - DNA, 90 bp, Canis familiaris
  misc_feature (60)..(60): n is a, c, g, or t
  misc_feature (62)..(62): n is a, c, g, or t
ccgtgcgtcggctttgctgggcgagcacccaccctacacatacggagctgagcccacgtncngctcctgcagtattaaacgagccttgtg

SEQ ID NO: 11760 - DNA, 342 bp, Canis familiaris
  misc_feature (37)..(37): n is a, c, g, or t
  misc_feature (56)..(56): n is a, c, g, or t
  misc_feature (72)..(72): n is a, c, g, or t
  misc_feature (119)..(119): n is a, c, g, or t
  misc_feature (299)..(299): n is a, c, g, or t
aggttctagcgttcagatgcctcttttgtaccacgcncgccccgtgtgaagcaccncggccgtctgtccgcnccagcgtggcacgttaatacgaccccaagaaatcctctcgagtggtnaagagcccacgaatttgggagccaggtcatcaagctctcccccaactgctagagtgacagcgaagtacaggagcctcatctaacatggagctggacttgatgagatgccgtggagttccatcttaggtgcatctaacgtgaactagttaaatagggcagaaggttgccagccacagttcngtgcaagtgtcagatgggagaccagactttgttctctttggct

SEQ ID NO: 11761 - DNA, 300 bp, Canis familiaris
gctctgggtgttcttcctggtgatcctcaccctcagcagtggctcccactcttccccgccatccctgcccatcagaatccctcggtatgcagacgccatcttcaccaacagctaccggaaggtgctgggccagctgtccgcccgcaagctcctgcaggacatcatgagccggcagcagggagagagaaaccgggagcaaggagcaaaggtacgactcggccgtcaggtggacagtctgtgggcaagccaaaagcagatggcattggagaacatcctggcatccctgttacagaaacgcag

SEQ ID NO: 11762 - DNA, 290 bp, Canis familiaris
  misc_feature (143)..(143): n is a, c, g, or t
  misc_feature (219)..(219): n is a, c, g, or t
  misc_feature (243)..(243): n is a, c, g, or t
agagccacgtggttccgcccgttctgcggaagactgagcaggatcacggtggcacaggaagagacggctggatagtggactatttccacatcttcgggcaaggacagagatacctgaacaggagaaattgggcaggggcaggncattccttccagcaggtgaccgggcatgattactacaatgcagaactgaggatgatcagggggttcaatggccgantttggctaccgccgaaacaccccnagccctccgccagcgcccgtcggtctttggagaggtcacccagttcc

SEQ ID NO: 11763 - DNA, 393 bp, Canis familiaris
  misc_feature (171)..(171): n is a, c, g, or t
  misc_feature (247)..(247): n is a, c, g, or t
  misc_feature (271)..(271): n is a, c, g, or t
agcaggactgcacgccgccggtacttccagagccacgtggttccgcccgttctgcggaagactgagcaggatcacggtggcacaggaagagacggctggatagtggactatttccacatcttcgggcaaggacagagatacctgaacaggagaaattgggcaggggcaggncattccttccagcaggtgaccgggcatgattactacaatgcagaactgaggatgatcagggggttcaatggccgantttggctaccgccgaaacaccccnagccctccgccagcgcccgtcggtctttggagaggtcacccagttccccctcttctaacaacatctttacctttcctactcctggacctgaatagaagacagatgtttagatgaacttttta

SEQ ID NO: 11764 - DNA, 267 bp, Canis familiaris
tttggcttggactgaaccctcaagtggcccttctgcccccacactaatggggacagctggtggctagggccctccatgggctcaggtcacccccttgactgggctccccttccttcctgagagtgctcggggcctccgctgcccctccactggtgcctctgcaagcgtgcgacagccgtgttcctgttctcaaagcaggacacgactgacctcccccggttctgtggcataagctgtgtaactgagcattacagacattttagcatc

SEQ ID NO: 11765 - DNA, 425 bp, Canis familiaris
aggcccttctcctactgagatggtactgcaggcgccctatgggaaaagtggtgaagctggtggggctactggaaatcacatttccatcatgtgcataaagctggtctactgtggaagagaatgacattgaccagcaaaaacatgcagagaggagacaaagaaattccccagatcgcctgaatgtctggctctggttcctgagttccctgagaccaccctggttctcaccttccagaaatctagtgcggaagaaccatccccctctctcacgcttgggtgaagaagttcattggaacagctgcttttctccctccttgttaactgagtcccatggaaagtggcctgcccgggacgaagaaagagggacacgatgtgactgcagagtgaggatctcccgttgagtggcactgctgacggagatcacc

SEQ ID NO: 11766 - DNA, 508 bp, Canis familiaris
  misc_feature (89)..(89): n is a, c, g, or t
  misc_feature (99)..(99): n is a, c, g, or t
  misc_feature (227)..(227): n is a, c, g, or t
  misc_feature (267)..(267): n is a, c, g, or t
  misc_feature (407)..(407): n is a, c, g, or t
  misc_feature (428)..(428): n is a, c, g, or t
tcccaggatattcacgggctactgaagccagcaccaagttgacatacccgcccctctgtagtgctccccgcttctccatccaacctccngctgcgatgnaaccccagttagaagagactcagcaacgagccacaccctaagtcatcctggcaaagaaccccatctggacacagggtgatacaggtccttgaggttgccctacagacagcaaaagcaaactgaagagnttctttcgaaaggaaaagaaaacacctgtagagcatacangaggcaggcagatttcagagcagctgctatgaaccaactctgcaacctgtgaagacacatgggagccctgcacttttctgatcccctggaatgactcagctgtggagcaagggcatccagggcaaagactcatactgccnacctgctgcaccacttgcctngctctgcagacctctgagcatcagggaaggacagggacggggtatctgtgcaggggaacatgagctcattctttctcagg

SEQ ID NO: 11767 - DNA, 357 bp, Canis familiaris
  misc_feature (90)..(90): n is a, c, g, or t
  misc_feature (105)..(105): n is a, c, g, or t
  misc_feature (126)..(126): n is a, c, g, or t
  misc_feature (165)..(165): n is a, c, g, or t
  misc_feature (257)..(257): n is a, c, g, or t
ttcagcctcacctgcaggaacattccatccagcacgaacgggctacgttccaggaactcctcaataaacagccaagtctcctagatcacncccccaagtggctgncccaagcagcagcagacctcnccatgccactcccgacttgccccgacactttggactccnccagtatggcctcctcctccccgaacgaggcagtcagcagcccagagccccttagccctacaatggtgctatcgcagggtttcctgaacctncttctctgggacccggaaaatgaagagttccctgagacactgctgatggacaggacccagctcaaagccctggcccctggatcccaggagagaagctcat

SEQ ID NO: 11768 - DNA, 128 bp, Canis familiaris
ggagagaagctcatcgttctctggggtggctgaccagtgaccgtcagagcaggaagccctcctccctcctgcagctggcacaccagggctgtagcaagcagcgtgtaaatacccgctggcccaaactc

SEQ ID NO: 11769 - DNA, 590 bp, Canis familiaris
tccttgctcaactgcgaaaacttaaggcccaaaggacccaggcccgggaactatcgcaggaaaacttagtcaaactcaccgtggaaagtaatgccgccctcaaggccctgagaaagatcgttgataagggtgaaaagatcctgaaacttgctgaaatatgtaggaaatttgaaacagaggaagaaaaagtgctgcctttctattcatcagtattgactcctgaggagcaggagaagatagaagaaatctacccagaggagcttactgaggagctcgcaaaggtgatagtgaactacacagggatggagaatttctggaaaaggtacaacaaagtgaaactggagcagctgagcctccaatatagacatgcccagttgttagaaatcaatgggaagttgcgggagatgctgaagcagtacttggatggcatctcagtgagtgacgaagtgctgagccagctcaacccactctttatcatcaaccatcgaagtaacttaccccagcctttgtcgacacctaccacccagccaggtgataaaccacctccaaccacttacaatatcattgaagcagcccatgtgatctcccac

SEQ ID NO: 11770 - DNA, 307 bp, Canis familiaris
  misc_feature (242)..(242): n is a, c, g, or t
gagtttggcttctatatcacctgtgagggccccaggtgccctttttcccaggtcccagcactgccatcccagctagagctatgtgagcaggtgtttgggctctcagcctcatctgtagtgcaggctgtggcccagacaaactcctactacggtggccagaccccaggggccacccaagtgctcttcattaacggggacacagacccctggcatgtgctaagcataacacaagcctcaggtcncttggagtcagcccttctcatcccaagtgcttcccactgcatggacatggcaccggacaggccct

SEQ ID NO: 11771 - DNA, 373 bp, Canis familiaris
ttttaaaattgcaccatcagagagtggatggtggcaagtgcagccagcaggaggggaagacctggaaggccatccgtgtggacctggtcatgtgcccctatgagcgccgtgcctttgccctgctgggctggactggctcgaggcagttcgagagagacctccggcgttatgcctctcatgagcggaagatgatcctggataaccatgcattatatgacaagaccaaggtagataaaactttcactatgtcagcattgagatatttaaaaatatctgaatgcacatatttctttttatactttcagaaaatattcctcaaagcagaaagtgaagaagaaatttttgcacatctgggattggattacattgaacc

SEQ ID NO: 11772 - DNA, 402 bp, Canis familiaris
ctgcctgcagacagagaagcgtcatgggcttctggaagttctcccctttcctggttctcggcatcctggcgctgtaccaggtgggcttcctccaggcagcaccattcaggtctgctttggaaaatcctccagactctggtgtgcgcaatgaggaggaattgcgcctcctcctggctgcagtgatgaaggactatatgcagatgaagactcatgagctggagcaggagcaggagactgagggctccagggttgctgtccagaagagatcctgcaactctgccacctgtgtggcccattggctgggaggcttgctgagcagagccggaagtgtggcaaacaccaacttgctgcccaccagcatgggcttcaaggtctacaatcgacgccgcagggaacttaagg

SEQ ID NO: 11773 - DNA, 126 bp, Canis familiaris
acctgtgtgacccatcggctggcaggcttgctgagcagatctgggggtgtggtgaagaacaacttcgtgcccaccaacgtggggtccgaagcctttggccggcgccgcagagaccttcgtgcctga

SEQ ID NO: 11774 - DNA, 97 bp, Canis familiaris
agctacagcaagtgaccatctcctaagaccctcctgcccagccagccagccccacctcagcctgccaccaggggcatcttattctctaaaatagcca

SEQ ID NO: 11775 - DNA, 441 bp, Canis familiaris
  misc_feature (274)..(274): n is a, c, g, or t
ggagagcccgaggaaatgtcttcatgtaccatgctcccgaaagctatgaccaccgcagcctggaattgctggcagatgttcagtatgccttcgggcttcccttctatcctgtctacgaggggcagtttactctggaggagaagagcctgtcgttgaaaatcatgcagttcttttccaactttgtccgatctggaaatcccaactacccgcatgagttctcaaggaaagcctctgagctcgcagccccctggcctgacttcgtcccgcgcactgntggggagagctacaaggagttcagtgtcctgctccccaatcgccagggcctgaaaagcgctgactgctccttctgggccaagtacatccagtctctgaaggcggtggcagatgaagccaaacaagagctgtcagcagagagtgaagaggacgacgagccagctgact

SEQ ID NO: 11776 - DNA, 128 bp, Canis familiaris
actcatagaccaggttagaggtaagagtgagggaagcctcttgagattccagaggatttcgaggtagagtcctccaatttctgcttcattcctcatgcttcatcaccgatgaataaatctattttcta

SEQ ID NO: 11777 - DNA, 370 bp, Canis familiaris
cagcctggacagctccagagctaagcggtgcagtaatctgagtacctgtgtgctgggcacatactcgaaggacctgaacaactttcatacattctctggcatcggcttcggggctgaaacacctggcaagaaaagggacatagccagcggcttggagaggggccgctaacctcgctttggggtgccccaggatgccaactgatctccttccactccttcctgacttcccttcttgctcccattgatgaatttaatgcatgcagatttcacttggattgctcttccagctggcattggtagctttgcttgcgagagagaatattggggatctcaggatggaagggaagtgagcagcactcatagaccaggt

SEQ ID NO: 11778 - DNA, 487 bp, Canis familiaris
  misc_feature (35)..(35): n is a, c, g, or t
agctgggccaggtctcagaggacctggcttggccnctatatgcaagtaggacaaaggttccgagaatgggtcactggctcaggaccccagggagcaaggccctcccagtccatgctgtgcagacctcaggcctcacaaagctctgcagttgcccctcctcactaggcatcctcttggttctgctcagtgaatccttggccctgctagcacccccacctacccttcccaccacttgagattgcacccccaccctaaagccaggggccgggaagcaaacagctcttctgtgaagcaaagctcagcatggaggcggctagtcttggaaggcagccaagctcggtcacctgcctggtggacatggagtgtggggcaggggccaggggcccacagacaggccaggctgctctgggaggtggaggctattcctggccaggctgtccagcttcctgaggcccctggggcatgcaggaggccagggttttagtta

SEQ ID NO: 11779 - DNA, 243 bp, Canis familiaris
  misc_feature (122)..(122): n is a, c, g, or t
atggtgaccgtgtaggcagaagcccatcagggatgctggcagacgatggccttggtcctctcttgtttctcttgggtctgcaggctgctctgtccatgggtgttaggtcttgttccactccnctcaagaaatctttccacatcatctggctcttggagtctgagaagccctgctcccaagagtgtgattaggtgaacaaatatattaagagggcaacgggtactctcatccactctggaaatg

SEQ ID NO: 11780 - DNA, 382 bp, Canis familiaris
gtttactcaacttcgaaaaagcatcagctgccgatacacctgaaagatcttgtcacaagacattgtgtgtgaagatgatgtctgcaaaagacatggttaaagtaatgattgtcatgtttgcaatttgttttcttgcaaagtcagatgggaaacctgttaagaagagatctgtgagtgaaatacagtttatgcataacggcaaacatctgagctccatggagagggtggaatggctacggaagaagctccaggatgtacacaactttgttgcccttggagctccaatagctcacagagatggtagttcccagaggcccctaaaaaaggaagacaatgtcctagttgagagctatcaaaaaagtcttggagaagccgacaaagc

SEQ ID NO: 11781 - DNA, 491 bp, Canis familiaris
  misc_feature (27)..(27): n is a, c, g, or t
  misc_feature (157)..(157): n is a, c, g, or t
  misc_feature (213)..(213): n is a, c, g, or t
  misc_feature (327)..(327): n is a, c, g, or t
  misc_feature (329)..(331): n is a, c, g, or t
  misc_feature (333)..(334): n is a, c, g, or t
  misc_feature (336)..(339): n is a, c, g, or t
  misc_feature (341)..(342): n is a, c, g, or t
  misc_feature (344)..(346): n is a, c, g, or t
  misc_feature (348)..(356): n is a, c, g, or t
gctaaatcccagtgacgatacatcagngcactgctgtagacagcatagggcaacaacattacaagctgctaacattttcaagctcttaagattaataaatgccaaaatttacatgtaatccattgttagccatgatagctgaaattttaattgattnttttgattctagtttaattcatttaagagctcttttaattgttctatttctattgnttattctttttaaagtatgtttttgcataatttataaaagaataaaattgcactttttaacctctctcccatcttatgatgcaaaataaaaatttaatgatcataattttaaanannntnnannnnannannncnnnnnnnnnaactctaagcattcagtaacttcacattctttataccagaaaggaggcagactttacatctcattagtactaaacaaaacaaggaaaaatgggcgcccttttaaaaaatacaaatttttattccccaccatattg

SEQ ID NO: 11782 - DNA, 549 bp, Canis familiaris
  misc_feature (280)..(280): n is a, c, g, or t
  misc_feature (304)..(304): n is a, c, g, or t
  misc_feature (322)..(322): n is a, c, g, or t
  misc_feature (343)..(344): n is a, c, g, or t
  misc_feature (356)..(356): n is a, c, g, or t
  misc_feature (519)..(519): n is a, c, g, or t
gagaacagagccagggcccagacccgtccctgggtggatgaggacctaaaggacagtactgacctccagcaagtagaagaagatgttgatgactggcaagagtcagaggaaaatgttgaacatattccattctcccacacccggtatcctgagaaggaaatgattaagagatcccaggaattttacgaacttctcaataaaagacgatctgtcagattcataagtaatgaacaaatccccatggaagtcattgataatgtcatcaaatcagcagggaccngccccaagtggggcccacacgganccctggacctttgtgatngtgaaagacctggatgtgaannacaagattcganagatcattgaggaggaggaggaaataaactatttgaaaaggatgggacgccagtgggttacagacctgaagaagctgagaaccaactggattaaggagtacttggacacagctcctgttttgattctgattttcaaacaagtacatgggtttgctgcaaatgntaaaagaaaggtccactactacaatgaaat

SEQ ID NO: 11783 - DNA, 113 bp, Canis familiaris
atgggattctggaagttgtccccgtttctggccattggtctcctggtcatgtatcaagcaggcatcctacaggctgcaccattcaggtctgccttggagaacccactggaatc

SEQ ID NO: 11784 - DNA, 150 bp, Canis familiaris
gactatgtgcagatgaaggctcgtgagctgcagcagaggcaggagactgagggctccagcctcactgcccagaagagctcctgcaaggatgacccctgtgtgaccaaccgtctggaaggctggctggccagagctgagcgcatggtgaaa

SEQ ID NO: 11785 - DNA, 566 bp, Canis familiaris
ccccgtgtgcagagatatcaatgagtgtgaagacgcgagccaccccccctgtcacgggtcggcccggtgcaggaacaccaagggtggtttcaggtgtgagtgcacagaccctgcggtgctcggggaggacggaacgacgtgtgtagactccgggaggctcccgaaggcgtccttggtctccatcgcgttgggcatcgtgctggtcgttggcctggcgggtctcacctggacgctggtttgcaggtgggcacatgcgggccgcaaagcctcactgagcatcgcggagttgggcggaagaggagcccccccgccgggccgtggagcgggccaggacggcgcctctggcagcctggtgccccccctcgggccgcagggcaggacccgggccgtggaccccacatccagtaggagccacgtggcgcagggaagcccggcatgagcaggggcagctgcgggccacctcctgggagcagaggtcggtccccagcacgacgggggacggtgttccctctggaaacaaccccgacccccacgtttctacctaataaagtgtgtgccgcttcccg

SEQ ID NO: 11786 - DNA, 232 bp, Canis familiaris
ggctccccagcgacgctatcgaaaggggccgaaacttcaagattgtcacggaggtgcagcaggatggacagaacttcacctgcgttttgcttctcttccaggccaccgtgcacatggacggggggaagatcgtggtggacttccccaactatcaccagacctcggaggttgtgggtgacaaactggtggagatctccaccatcggaaacgtgacctatgagcgtgtgagcaa

SEQ ID NO: 11787 - DNA, 381 bp, Canis familiaris
gagaagttcttggtgctgttgccactagtggtcctggcgctgctggggctggcctgcgtgcagccttctctggccagggagtcgaaggccatgaagttccaacggcagcacatggactcgcaccccgccgccatcagcgccagctactgcaacctgatgatgaagcgccgcaacatgacggatgggtggtgcaagcccgtgaacaccttcgtgcacgagcctctggcagacgtccaggccgtctgctcccagaaggatgtgctctgcaagaacgggcagtccaactgtcaccagagccgctcccagatgaacatcaccgactgccgcctgaagaacggctccaagttccccaagtgcgtgtacacgaccacgcagaaggag

SEQ ID NO: 11788 - DNA, 227 bp, Canis familiaris
  misc_feature (47)..(47): n is a, c, g, or t
gtgcactttgatgcgtgtctgtagctctcggcctgaggccagagaancgggcgccctgtcgcaggtggcacctgctacccctcccctgccttcctgctctggggaatccctgcagccggggctcctccggcttgctcccaaacccgggctgccctgcccagggctgctccgcttggtcggggggcgggggccccatgttagccacctcaccgcttctttcaataaag

SEQ ID NO: 11789 - DNA, 262 bp, Canis familiaris
  misc_feature (26)..(26): n is a, c, g, or t
  misc_feature (41)..(41): n is a, c, g, or t
  misc_feature (55)..(55): n is a, c, g, or t
  misc_feature (70)..(70): n is a, c, g, or t
  misc_feature (79)..(79): n is a, c, g, or t
  misc_feature (139)..(140): n is a, c, g, or t
  misc_feature (181)..(181): n is a, c, g, or t
  misc_feature (188)..(188): n is a, c, g, or t
  misc_feature (191)..(191): n is a, c, g, or t
ggatgggtggtgcaagcccgtgaacnccttcgtgcacgagnctctggcagacgtnccaggccgtctgctnccagaaggnatgtgctctgcaagaacgggcagtccaactgtcaccagagccgctcccagatgaacatcnnccgactgccgcctgaagaacggctccaagttccccaagtgngtgtacncgnccacgcagaaggagcagtacatcgtcgtggcctgtgaggggaacccccacgtgccagtgcactttgatgcg

SEQ ID NO: 11790 - DNA, 478 bp, Homo sapiens
ctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatat

SEQ ID NO: 11791 - DNA, 450 bp, Homo sapiens
gaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgaga

SEQ ID NO: 11792 - DNA, 366 bp, Homo sapiens
  misc_feature (147)..(152): n is a, c, g, or t
gacacataacagacatgctatccaccatttatttgtgattttgtaagagggttctcttctttgtcttgttcagatattttcatgtgtgtgttttagtgagaatctgagtttttaatcagtaaagtctgatgttttgataacttgaannnnnnatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacaggggagactgatttccattccttat

SEQ ID NO: 11793 - DNA, 394 bp, Homo sapiens
ggactgtaaatgttccctactggaatagaaatatgtctctctccaactttccaccaaataaaatggttagagtgaatgcccagtttcacatctgccttttggagtttggaaagcttaaacaagtcagttaagagaatgagaagaatctcactgtgggtgataaggagtgtgtagtttgctgtaagggccactgatatgacaagaatgattatcccacagtaagaatgggtaaaacttaataaagttttctaactttattaaactcacattatttaatgaaaaaataactgcaaaggaccaatgagatcatgcatgctgctgtattcttgtgatggaatctaccaggattaagttgtatttaaatgaaaaaacaggtacacatttagagatcatt

SEQ ID NO: 11794 - DNA, 412 bp, Homo sapiens
  misc_feature (63)..(63): n is a, c, g, or t
  misc_feature (92)..(92): n is a, c, g, or t
  misc_feature (101)..(101): n is a, c, g, or t
  misc_feature (114)..(114): n is a, c, g, or t
  misc_feature (122)..(122): n is a, c, g, or t
  misc_feature (138)..(138): n is a, c, g, or t
  misc_feature (149)..(149): n is a, c, g, or t
  misc_feature (193)..(193): n is a, c, g, or t
  misc_feature (216)..(216): n is a, c, g, or t
taatctaataatctttatctgttcttatttattttatgtatgttcttctaaccttgcaccccncaaggacatggactctattgacacactanccctagcanctcagaagaatgncctgacancatagaagttgatttngcaaatgtttngttgaaagaataagtgattgaatgaatgaatagaaactattttncttatctatgtgccaatagtagnccaggtagaaaatataatggtgatgaaaagagattgataggaacaaaaattattaaaaagagcctaggagtaaactttaaaaatacgtaggacctacattcattcattgactcagcagtctatatcaagcacttaactctgccaggcactatgattttaaggataaataaggcaaacatgatccttgcttgttttg

SEQ ID NO: 11795 - DNA, 432 bp, Homo sapiens
  misc_feature (86)..(86): n is a, c, g, or t
tactctgcacatcttggctacattaaaatggactgacagaattatttaaaaggcactatgaaggtagaacactaccttaatatttntatcctagtcagaagcctgatttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtt

SEQ ID NO: 11796 - DNA, 525 bp, Homo sapiens
  misc_feature (93)..(93): n is a, c, g, or t
  misc_feature (141)..(141): n is a, c, g, or t
aaatgctttctgcatgtagccaaagcaaaacataatagaataaaagccagagactgtatatatttataaattagatcctaatctactgcaagnataacttttctatttttaactatataaaataacctctgtctcagcatngggactgtgttagcaactattattgtggaataacccagaacattggatttataccaacaaataggcaatattaatacagtgtattaataaatttattacaaattattaatacagtgtattaataaatttattacaaattattaatacaggtaaatgttttatttgtagacatggactgtgaaataaacccaacacatcagtttttaagttcttattggtgtggtatcctctaaattaatgttatagaatctaaaaattcatgttgaaagggaatgattaaaacaatgtaaatctaaattgtatgtcatgcatgttttgagaatggtgaatgtttaatgctcatgaaaattgggggagggggttctattaacacaaagcttctga

SEQ ID NO: 11797 - DNA, 523 bp, Homo sapiens
  misc_feature (58)..(58): n is a, c, g, or t
  misc_feature (317)..(317): n is a, c, g, or t
  misc_feature (362)..(362): n is a, c, g, or t
  misc_feature (375)..(376): n is a, c, g, or t
  misc_feature (445)..(446): n is a, c, g, or t
  misc_feature (448)..(448): n is a, c, g, or t
gggatttcacattataacctacacagagtgaatcgtctcaagctaaaaacacagaaangatgcatgctcttctatgctttctctttatacattactcttgcctgtcttttagttacaacaattttatacagactttgtttttactatagatattttctttaaatactttttctttgaattcaaaaagaaatgcaatgtaagttaaagactctaaaaataaccaaattaggacaaagattttagcaatggcaattaaaggaaggacatgacattcaacagtgaccatagaattcccttttcaagggagattcaggtangtatttgcattttaaagatgctgataagtctttcagttaataaancttttagcctganntttcatacttttgcttgagcatttgaaacttttctcaagttagaatattatgctagaatgatatttttnntnttttatgctataatgttgcgttgatcttgggtattcaaaaatgtgctgaaactacagtaagctcacttcttgggg

SEQ ID NO: 11798 - DNA, 283 bp, Homo sapiens
gtgctgtggccagggtgagagctgctctggaaaatgtgacccagatcctcacaaccacctaatcaggctgaggtgtcttaagccttttgctcacaaaacctggcacaatggctaattcccagagtgtgaaacttcctaagtataaatggttgtctgtttttgtaacttaaaaaaaaaaaaaaaagtttggccgggtgcggtggctcacgcctgtaatcccagcactttgggaggccaaggtggggggatcacaaggtcactagatggcgagcatcctggccaa

SEQ ID NO: 11799 - DNA, 315 bp, Homo sapiens
  misc_feature (28)..(28): n is a, c, g, or t
  misc_feature (73)..(73): n is a, c, g, or t
  misc_feature (248)..(248): n is a, c, g, or t
tgaggtcaggcaaaccttccagcaatcngttctgcccagagaacatactgacgacagagaacacactgagcgntatctgcttctagttagagcattgccgattgccttcataattcataatgtgctgtgctcctctgagggtctatctgtatttctcttcaaagaattccctttttaaattcttgcagctgggttttaagacacaataatggggcaaattaagttttataaacttggagatttttatncagtaaataaaaaaataatatgtactagtcacccctgaaactgcattcttagaactcgactcttgtt

SEQ ID NO: 11800 - DNA, 393 bp, Homo sapiens
  misc_feature (29)..(29): n is a, c, g, or t
gggacgcagcccaacaaaatgagtattgntcttaaaatccccctcccctaccaggacggctgtgctgtgctcgacctgagctttcaaaagttaagttatggaccaaatcccatagcgagcccctagtgactttctgtaggggtccccataggtgtatgggggtctctatagataatatatgtgctgtgtgtaattttaaatttctccaaccgtgctgtacaaatgtgtggatttgtaatcaggctattttgttgttgttgttgttgttcagagccattaatataatatttaaagttgagttcactggataagtttttcatcttgcccaaccatttctaactgccaaattgaattcaagaaaccgatgtgggttttgtttcctgtacaattatg

SEQ ID NO: 11801 - DNA, 473 bp, Homo sapiens
ctttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaact

SEQ ID NO: 11802 - DNA, 512 bp, Homo sapiens
  misc_feature (79)..(79): n is a, c, g, or t
tttatgatgactcagtggtgccagagtaaagtttctaaaataacattcctctcacttgtaccccactaaaagtattagnctacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttacttt

SEQ ID NO: 11803 - DNA, 196 bp, Homo sapiens
cttgaagacagactacatttttcctgagcgagacaatttggtctcaagggaaaccaaactgtagcacagaatgtgagagacagcaacaataggatggaatgcataaaatccttccccagagcaagcttctcccacttcttgaaaggctttatttttatatagcctctggaagccagacaaagtatcacttagaaag

SEQ ID NO: 11804 - DNA, 533 bp, Homo sapiens
attctttccatgacacccaagggtcgcctatttttaaaaagtaccacattccatgacgcaggagctgtggaaatggtgagcgctgtgagatggatgtatttgtagccagtctcctatacccagcagagggataacccaaacaaaaatgactctaaatagcccagatcccaagagattatgtaactcctccatccagtgttccaaatttgctttacatatgattgtatttgtgtatagggcaaaatattatttttatgcctggtaagtggctttttgtactgtagttcagatagagatattttgggtatattttcaagatacatgttgtatttatggaagaaagagttgtcctgatgtttttctgtgttacttatattagagtcagagatcttggtatgggctgttctgtttcctgtgtctccaagcctctgtcttttctgggatgtggtattggtgctttgtgtctagggcagagtatgttcttgaagaaaggcaaatctgactttttctgtgcgccttaaacaattcttgta

SEQ ID NO: 11805 - DNA, 313 bp, Homo sapiens
ctggtgggtggaagggtgcctggtttaggcggggtcccaggagggggtgaggggtgacacccttggggagggggcctgcaaagggcactgcctgtggccacgtggtgtctgtgggaattggtcctggggactttgatgggtgtttgcggccccagttgccgccctgctccctcttccagggctcctggcttgggccccccgacccccctgctcagctcgggaaaatccccgtgcggctccagccccgggtcacgctcaggagcgatgagaggggcgccctggccacgcttcaggaaagcctgtgtctgcgcgc

SEQ ID NO: 11806 - DNA, 442 bp, Homo sapiens
caccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagccccactgcacccccctgtgcctgctgggcactgggcactagctagatgctttaggttgcttcagctgatccttcaactctgtgaggtg

SEQ ID NO: 11807 - DNA, 487 bp, Homo sapiens
ggctcatgtactgctacgtacctgatgacgcgtggactgacccactgtacaatttctaccactacttctacatggtgaccaacacacttttctacgtcagctcagctgtgactcctcttctctacaacgccgtgtcctcctccttcagaaaactcttcctggaagccgtcagctccctgtgtggagagcaccaccccatgaagcggttacccccgaagccccagagtcccaccctaatggatacagcttcaggctttggggatcccccagaaacccggacctgaatgtaatgcaagaatgaacagaacaagcaaaatgaccagctgcttagtcacctggcaaagcaggtgagcaacctcatcactaatcattcaagcttcgcagccagggcgacttctatcaacccctgctctgctgagaaccatcaagcgcagggaagccacgtgacccctcctagcctcaggctccctcgtctgtgtagtggaga

SEQ ID NO: 11808 - DNA, 508 bp, Homo sapiens
gaggtgatctgacccattttgataagtctttataaggaagaataaaataaacgtgtaagcaaaattttcttttgtaaaagcaaaagccacatctcttttctggatccttcaggactggggtttgtttgcttccttttctgtttctgtcttctcgctgctctgtgcccttggttgttttgtggtggtcctgtcgtccctcgtgcccctcggccacctgctggcagccgatgggggcactcggacatctacaaccctgcaactttgtacagagaaacacaatcagctctttctgcatgtgctggtcaaatccaaacccagagaacagaagcgctttctaagaatgaacaaatatgtgaaataggatgttttgtgtagataaagcattcttgttacatactggtcaatttgtgatatgttttaacttaatgtctgtgtttatttatggaattcggttttcttaataaatgtttgagctaatataaagcatattatttgacttttccggaca

SEQ ID NO: 11809 - DNA, 380 bp, Homo sapiens
actgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaatttacagtaagttagcagtaatagactattcttttcaactatgaa

SEQ ID NO: 11810 - DNA, 438 bp, Homo sapiens
aaatctctcaatcttcaaataattcttagattgcttgccagcaaagatgtctcttgatcttgacactggaattcaatgtaaaaatcttgaatgatattttgtactgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaat

SEQ ID NO: 11811 - DNA, 385 bp, Homo sapiens
atatcctgccatgtgagctcagggaatgcaaatgcatttaaatatccatctaaagcaaacataattagaaaaatcaatcagctggaggaccccccaaagtttaatacattttcaataccaccaggaatggatttttggtccctttctgcaggtctgggttgccagacgttttatttctggggaggagggctctgggctgaggagctcagtgggtgggaggagggaatgggactgttgctgatcctcaaaggcctctgtaggatggagggaggggaccttactcccttccccaccccagatgcaggagtcacccagcttccttctctgcgctgtttccttcacaaattagacattggtttgggaaacaatgtagcctcgttaaaca

SEQ ID NO: 11812 - DNA, 573 bp, Homo sapiens
attagttgcaaaatccagtaggttaaaatactcacatatttttacttaaattttctttaatttacttatatgttattataattttgaatttttaagttctatgattcatgttttaaagatggaataattttaatacatattttgtttaaatataatctataattgttttgtaatgtaagactaattactaatatttatgtagcaacttttgtgccagaaaaaagactgttaatttgttttttcttgcttttcatttgattaccctgcttgaaatacagttagttgataacataaagccatagttttcttggattttcttccaagatattgtattcccaagaagaaattgatttatttttaaactatcagttactgaagacttatgaaaaggtcaatttttacctgtcttttaatccagtccattttctgacacaatattaaacagaacgccagttgcatttactttggtgatttgcaaacttggaatgaagccaccagtcattttttaagaatgcaagatgaaaaaatcaggtaaaatctaaccattttattctctgcttcatagcattctaa

SEQ ID NO: 11813 - DNA, 249 bp, Homo sapiens
  misc_feature (42)..(42): n is a, c, g, or t
  misc_feature (138)..(138): n is a, c, g, or t
  misc_feature (140)..(141): n is a, c, g, or t
  misc_feature (187)..(187): n is a, c, g, or t
  misc_feature (208)..(208): n is a, c, g, or t
  misc_feature (211)..(211): n is a, c, g, or t
gatttctgttcctcaaacaatttctgaaatatttatgtcagnataaataaaagaattgttattgttggacaatgaaacatacctggaccctttgagtgtgtgaatagtaaaggctgtgataactgaaatgcagctaancnnaaagggctaattagaagacttttgagacatgatttacctaaatggnaatagtttggttttcaatccntcnctgtaataacaattatttgcatctattaagtgtttgta

SEQ ID NO: 11814 - DNA, 456 bp, Homo sapiens
gagacacaagctcataatgttccatgtataaaagtaataactttattgggtagagatattcttacaagatctagcacctctgccagtgcacagataggactgttttaaatgatttgggaacttttggttgcctgcagttgtgaacagagaacttctctacagagaaacaaaccactaaaagcaatatgaccgagttgagatgtggtttccaatgagcaattggtgaatttaagcaacctggatgtgcatatgtggaggctcccgtctcactgtttgatcaaacttcttttatgtagtcacgtagacttgattttttctgctgtgaaaatgaaaaaataaagcaatatgacaaaaagtttaaaaatgcataaaaaataggatttcctctaggctcctcgaagagatttttttaatatgatgcttgtcttactttcttagacacgttacatttcccct

SEQ ID NO: 11815 - DNA, 530 bp, Homo sapiens
gaggcgaggagataccaacccaaaagccagaccagtgacaatggatagaatgggctgtgtttccaaacagattgacttgtcaaagactctcttcaagccagcacaagcatttagatcacaacactgtagaaatttgagatgggcaaatggctattgcattttgggattcttcgcattttgtgtgtatatttttacagtgaggtacattgttaaaaactttttgctcaaagaagctttcacattgcaacaccagcttctaaggattttttaaggagggaatatatatgtgtgtgtgtatataagctcccacatagatacatgtaaaacatattcacacccatgcacgcacacacatacacactgaaggccacgattgctggctccacaatttagtaacatttatattaagatatatatatagtggtcactgtgatataataaatcataaaggaaaccaaatcacaaaggagatggtgtggcttagcaaggaaacagtgcaggaaatgtaggttaccaactaagcagctttt

SEQ ID NO: 11816 - DNA, 157 bp, Homo sapiens
aaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcct

SEQ ID NO: 11817 - DNA, 400 bp, Homo sapiens
  misc_feature (104)..(104): n is a, c, g, or t
agcctcctttgcgtcattttaaacgccctgcttacgcatctagctcctatgcaccttcagtctcaaagaaaactgatgagcatcctgcaaggtacaagatgctngatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagca

SEQ ID NO: 11818 - DNA, 154 bp, Homo sapiens
aggaagcctttattggttgggctaggctgggctagctgtggaagatagacttctatgtccctgccccaaccacaattttactttaattattatgtaattagtgaatcgatgtctgtcaccgtctgtagatgctgaggtcttgttcatctcttta

SEQ ID NO: 11819 - DNA, 529 bp, Homo sapiens
  misc_feature (132)..(132): n is a, c, g, or t
ttatttgtcataagccagtcctcaaaagagttcctaacagtagtgatttctaatatataagaataaggtacttctgagggaattttatattttcagagtttaaaattattgctactcccaatttagaaaaanggggagaaagctggaagaacaaatgacatgctcaaatgtattgcataagtcaacctcacaccttaatactgggagcttctctgcctcctgatcctgtcttgcagataaggtcccctggctaggtttgcgtttatagtcaggttccatttagctcattaaaggtcactgctgcttcaaaggactttgcccagtggatgccattcataaccacagatgaatgttatcagctatttatccaaattacaggaaatgaaacctgaaaaggttgggtaagaatagtgttgaaaattcatagttttaagtttgatggtctccattcaggcaagtgtgtttcagcaaatctctagaaatttacattgattaaaatgttagaggctgttctggaagttctagacat

SEQ ID NO: 11820 - DNA, 441 bp, Homo sapiens
tggggctactagctattgtgttagatagcacggtatactttattctctttcttgtgttgtagaaccagctgggagaggtgtgggtcagtcatgggcttggtatcccctggtcttcactattctagcttgccattgaatttgtctcccagaggaaaagaaagaatggtatttggaattaaattcaagatgttaacttgacatctatatattgcacatattcctgtatagtgaatggatgacctcctgggaatagttcctgtgactgattttagtgataattgatcatgaagaaatggcagtactgctccacttcaccttcctagtgactattatgtgttcctagtcagagtgactcagcagagattattttgttctcttgtgcaatttattctgtgtcattttatttttgtaatattgtggcagctaaatgattattctgtg

SEQ ID NO: 11821 - DNA, 456 bp, Homo sapiens
tcagtgcgctttcctgcgcgcactgcggagggcgccctaagcgtcacccaagcacactcacttaaagaaaaaacgagttctttcgttctgtgcgcagtaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgccctgtcggtcccgccctccccccccgccgggctcctggggctgtggccgaaaggtttctgatctccgtgtgtgcatgtgactgtgct

SEQ ID NO: 11822 - DNA, 474 bp, Homo sapiens
acagccttgggggaagtgtacagagatgtctctgaggttgcatggcatggtccttgtgatggtattactttttacaaagaatgaaaccaaatggactcagccctctcccacattttcccctcaccctccaagtcctaacccctccatcctctctaacttttcaagccaatcccttaatgtcattcctctctctgtgtatctgtgccagatgttttcctttcttccttctttactggaaggacctccacattcttccctccttggaagaggactttactaaaagtcacaggtggtggccaggggggatttccgaatctccatcaggcgcgctcatagttgtccccattgtctacccacacaaatcctcaggaaaccaaccaccgcccaggtggccctgagggaggcattcacctttatgtgttagaaaaacatgaccagaaatcaaagatgtcagagccccgaagcagctaatgt

SEQ ID NO: 11823 - DNA, 315 bp, Homo sapiens
  misc_feature (31)..(31): n is a, c, g, or t
  misc_feature (86)..(86): n is a, c, g, or t
gtgggaaataattctgttttagtgaataagnctaattaaagtctatccagaccaccatgtttttatttacagtgactatatatatnccatgattttgacatagagtataattctgatgttacttatttcaatatgccttgtatatattagctgtttataagagagtcgctttttggttgaaaagtatttctaggctgagcaaggtagctcatgcctgtaatccaaacactttgggaggccaaggcaggaggatcacttgaggtcaggagttcaagagcagcctgggcaacatagtgagacctcatctctacaaaa

SEQ ID NO: 11824 - DNA, 488 bp, Homo sapiens
gaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtcca

SEQ ID NO: 11825 - DNA, 401 bp, Homo sapiens
catgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttact

SEQ ID NO: 11826 - DNA, 122 bp, Homo sapiens
acccctccgcactgtgaaagactaactcctgcaactggaaagcgggggcgcccgccgacgaggaggccaccgtgccaagccggcagaggtcatgccaggcgccaagggcaatgtgcccagct

SEQ ID NO: 11827 - DNA, 317 bp, Homo sapiens
gaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtatccgccgagagcccaggatgtactggcggatggggcctgc

SEQ ID NO: 11828 - DNA, 460 bp, Homo sapiens
  misc_feature (247)..(247): n is a, c, g, or t
  misc_feature (260)..(260): n is a, c, g, or t
  misc_feature (276)..(276): n is a, c, g, or t
gaatctagttatgccttcatcactgttgacagtaaatactgacagccccttgcagtgtgttagttttagatcactctgttttagttgagagaaatgttttatatcatggtttttatatgaatacaaattatttctcaaagatttatagcacacactattctcaggaattctgtattacatgaatgctgcttatatattttcatattctaacttgtcttttcaagcaaataactaatatatatgtgcnatgcagtctgccnttgacaagttgttccnaagctgaagagctttcactgtacaatgtgtggaaaatcaccatagatcatggctgaaatagtttgtaattgtctgagtctgtgcacgtacttttagataaaatgctgctgagtgactgcatgatgagatacaacttctgaatgctgcacattcttccaaaatgatccttagcacaatctattgt

SEQ ID NO: 11829 - DNA, 488 bp, Homo sapiens
  misc_feature (41)..(41): n is a, c, g, or t
  misc_feature (144)..(147): n is a, c, g, or t
  misc_feature (453)..(453): n is a, c, g, or t
  misc_feature (460)..(460): n is a, c, g, or t
cacctggtgccaccacagggcaccagggatgatcctgatgnggcaggcaggggagactcacagaaaaatctgcccagagcctaccctcaccagacaaactctgtgctcctccaaaacatcctttagatgcaaaataataataannnntaataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgnggggggngggtgggatgggaagaaggggcgtttgt

SEQ ID NO: 11830 - DNA, 434 bp, Homo sapiens
caggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgc

SEQ ID NO: 11831 - DNA, 514 bp, Homo sapiens
agattatatccctatcttctttttcatgtaaaccactggtcacaaatgaactgatctctgtatcccattattactataagaggtgggaatcccaaaactgcttagattgcagtacatgagtttacacaaagacttcaacaattgcacatcttcattctcccaactgagtgtagtatgtggagcataaaacagcatattcttagtatttcatgaatatcagatggtctttaaatgtctctttatggatgtattgttcacattatggctttaaaataatgaatatgtaaaagtgaggtagtgaacatcctaaatttctacactggaattactaaataatcttatttcataaaatgggaaatatatgttaaatgacatcactggatgaacttgaagatcttttacttgttaacaaaaaaatactatggacagctttctgattgttggggtaaatagcaaatgttcaaactttgcaggcattttgacattcatcataacaacacaattcctagacatt

SEQ ID NO: 11832 - DNA, 441 bp, Homo sapiens
ggcttcataatattccatgagtctggatttggttacagatagagctggacgagccttagctatatctaatggcttttgacatgttatatcaatttcttactgcttttgtaaatgaatatattaagaagaaaaaattacaaatgaccctttctttacaaacttttaggtaatcaagttcagttattaagaaatggatgtttgcaacattcatagtaattattttcagaaaattaaaaatgattaaaaattatattttcatcccattcagatattatatatttaactgtgagataattctcagagataaatgtcaacttttaaaaaatgctaaataaattaaatcaaaatatccactctaaaataaataaattagctccgattatttcttctttttaaatttttccttatagttgtaaaaataaagtgaacgttttggctcat

SEQ ID NO: 11833 - DNA, 536 bp, Homo sapiens
ggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttcc

SEQ ID NO: 11834 - DNA, 536 bp, Homo sapiens
agaaaactggcagtgcacctctcatcagcccaggtcccagtgccattggcttcaagaaaaaaaaaaatctctccccaatgctctccttaacctttaagtcttacaggaagcctctcatagaaattgcctccagtccagtttcccaaaaaccccagtgttttacatatctgtttaggagtgtctaagttttgtcatcaatccacgatgttattcttccttcccaactcactgtgctcctaaaggcagcaaccattcatctttcctttgctctggatacaccgaatgaccaggtaacatcatcaggccgggtgcagtggctcctataatcccgatattttgggaggccgaggagagaggatcacttaagcccaggagtctgagaccagcctgggcaacatagcaagacccccatctctgcaaaaaaataagaaaattagcttggcatggtggcacgtgcctgtagtcccagctacatgggaggctgaggtgggaggatcacttgagcccaggaagtccagaacgtagtgagccttgat

SEQ ID NO: 11835 - DNA, 241 bp, Homo sapiens
gatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacag

SEQ ID NO: 11836 - DNA, 380 bp, Homo sapiens
  misc_feature (161)..(161): n is a, c, g, or t
  misc_feature (173)..(173): n is a, c, g, or t
gtaatgtacatatgcatattgtctatgtactatatacacattgtttataatattgttattacagtttgtcattcacctgaaaggagaaggaaaagtacgaaaggtttctctgcttgggaaaaggtgaatgttgttatatcaagaacgattacacacatggntctcatacatgnttttagaacattgttcttctgattgaagaagtctgatgctcctgaaaaatcttaaaatatctgacttgtattgaagaaaattatttaattaaatttttaaaggctggttgaaaaagtctgacagttctgagaattttttaaatgtctgaattgtaataaaaaaatggtttactttaaacttctaaaaactaatgaccttgtgactaa

SEQ ID NO: 11837 - DNA, 552 bp, Homo sapiens
aactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggaggttttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctg

SEQ ID NO: 11838 - DNA, 526 bp, Homo sapiens
gaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggc

SEQ ID NO: 11839 - DNA, 453 bp, Homo sapiens
  misc_feature (153)..(153): n is a, c, g, or t
  misc_feature (248)..(251): n is a, c, g, or t
  misc_feature (269)..(271): n is a, c, g, or t
caagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagncatacccctgtatatcttagcagcactgagtccagtgcgagcacacacccactatacaagagtggctataggaaaaaagaaagtgtatctatccnnnngtattcaaatgaagttannnttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaa

SEQ ID NO: 11840 - DNA, 375 bp, Homo sapiens
  misc_feature (82)..(82): n is a, c, g, or t
gaccaatgatgttttcccatctctgaatgctagggggtcagtggtgggtacctggttacccctggggcatcttcactgatanctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactg

SEQ ID NO: 11841 - DNA, 206 bp, Homo sapiens
gtttctcttggtcaaaaacacactcaagtcgtctccaagttcgaagcattcagcaaacaatggcaaggcagagccaccagaaaggtacacctgattttcatgacagatatggtaatgctgtattagctagtggagccactttctgtactgctgtatggacaagtgtagcaacacaagtcggaatagaatggaacccatcccctgtt

SEQ ID NO: 11842 - DNA, 199 bp, Homo sapiens
gagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggc

SEQ ID NO: 11843 - DNA, 521 bp, Homo sapiens
gcccatgcccaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagttttctagtggacattttgtttaaaaagtctttgaattgccagttctgtaagtgccatcaatt

SEQ ID NO: 11844 - DNA, 129 bp, Homo sapiens
tccaaagaagatagcaactccacggagagcaaatcaagcagtgaggaagatggccagttgaaaaacattgagatagagagccggaaattaacagttgatgcctatcacaacaaacccattggggaccaa

SEQ ID NO: 11845 - DNA, 434 bp, Homo sapiens
  misc_feature (30)..(30): n is a, c, g, or t
gaagttcaactcaggaaggtgcaatataancaaatgtgctatattataatgaggaatggtactaccgttccagattttctgtaattgcttctgcaaagtaataggcttcttgtcccttttttttctggcatgttatggaatgatcattgtaaatcaggaccatttatcaagcagtacaccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatct

SEQ ID NO: 11846 - DNA, 399 bp, Homo sapiens
tagtctaaggccatggcatccctttttcataaattatttgattatttaagactaaaagttgcattttaaccctattttacctagctaattatttaattgtccggtttgtcttggatatataggctattttctaaagacttgtatagcatgaaataaaatatatcttataaagtggaagtatgtatattaaaaaagagacatccaaatttttttttaaagcagtctactagattgtgatcccttgagatatggaaggatgcctttttttctctgcatttaaaaaaatcccccagcacttcccacagtgcctattgatacttggggagggtgcttggcacttattgaatatatgatcggccatcaagggaagaactattgtgctcagagacactgttgata

SEQ ID NO: 11847 - DNA, 534 bp, Homo sapiens
tcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgt

SEQ ID NO: 11848 - DNA, 554 bp, Homo sapiens
gttagctgcaatccagcttcccaagaaggctggggatataacaaacaaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggaggagacaatggagaagaaggggaagaagaaagtgtcactggagccaatgcagaaggcaccacagagaccggagggcagggcaagggcacctcgaagacaacaacctctccaaatggtgggtttgaacctacaaccccaccacaagtctatagaaccacttccccaccttttgggaaaaccaccaccgttgaatacgagggggagtacgaatacacgggcgtcaatgaatacgacaatggatatgaaatctatgaaagtgagaacggggaacctcgtggggacaattaccgagcctatgaagatgagtacagctactttaaaggacaaggctacgatggctatgatggtc

SEQ ID NO: 11849 - DNA, 476 bp, Homo sapiens
accaatgcgttggagaacgagggaggacttcatagcagaagaattggagttggaaggttgcatagggtttcctcattggagaccggggaattctattcttgggataaataatagtaaattctataggattcaatacttagtttgcaaaagcactttgaaattatggcacagtgagttgttttggataagaaaatctttttctcccaattaatttaccaattcatcattttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaac

SEQ ID NO: 11850 - DNA, 528 bp, Homo sapiens
  misc_feature (33)..(33): n is a, c, g, or t
  misc_feature (127)..(127): n is a, c, g, or t
  misc_feature (156)..(156): n is a, c, g, or t
  misc_feature (174)..(174): n is a, c, g, or t
  misc_feature (182)..(182): n is a, c, g, or t
  misc_feature (192)..(192): n is a, c, g, or t
  misc_feature (297)..(297): n is a, c, g, or t
  misc_feature (303)..(303): n is a, c, g, or t
  misc_feature (321)..(321): n is a, c, g, or t
  misc_feature (334)..(334): n is a, c, g, or t
  misc_feature (423)..(423): n is a, c, g, or t
gaagtgactccagacattaggtccagacattangttaaaaatagaaagaggaataaagacatctcttctctctagaaaagataacaccacaattaataatccttcccactttcattgagatcagctntgtctgataacctgatatgagtgtgatantgataaacatgataatangtggtacntttgtaattntgctggtgcatttaagaagatagtaaatgatgagttcatcttttcttcgaacattcctattcctagatgtagtttacctcaaattgggaattataactgtctaanttttgntgtgtacctgatgccccntttgctttaatanccacagtgtaacaattaaatatcacactatgacatatgatttaagtaggatattttaaagataaattttaggggtaaatgtttacttcnaaatgactccatatttcaaatatctgtttagactgtgaaggccaaataatttttaagaaaacatttgaagagtagtgtgtttgcatttgtgaataatcttactca

SEQ ID NO: 11851 - DNA, 421 bp, Homo sapiens
  misc_feature (345)..(345): n is a, c, g, or t
  misc_feature (348)..(350): n is a, c, g, or t
  misc_feature (352)..(354): n is a, c, g, or t
  misc_feature (356)..(356): n is a, c, g, or t
  misc_feature (358)..(358): n is a, c, g, or t
  misc_feature (360)..(361): n is a, c, g, or t
  misc_feature (363)..(363): n is a, c, g, or t
aacatcgataaccatgcatcctcttgcttggccacctcctgaaactgctccacctttgaagtttgaactttagtccctccacactctgactgctgcctccttcctcccagctctctcactgagttatcttcactgtacctgttccagcatatccccactatctctctttctcctgatctgtgctgtcttattctcctccttaggcttcctattacctgggattccatgattcattccttcagaccctctcctgccagtatgctaaaccctccctctctctttcttatcccgctgtcccattggcccagcctggatgaatctatcaataaaacaactagagaatgntgnnnannnananannanagaattactaaggagaagatgcctctggagtttggatcgggtgttacaggtacaagta

SEQ ID NO: 11852 - DNA, 507 bp, Homo sapiens
atagtttcatcttccgaggccaataaagtgctcacgagagcgcccatcttacaatcaacacctgtcacacccccaccactcccgccagcctttggaggcaccagtaaaatagaccagtattctcgaattctcttcccagttgcatttgcaggattcaaccttgtgtactgggtagtttatctttccaaagatacaatggaagtgagtagcagtgttgaatagcttttccaggacaacctgaattctataagttcttgttttctgtttcctatgttttcttaaaaaatagcattgagacttgtgtagatgcttctcagaacatgaaatcaaattggaaatctgtaacgcagcttctgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattg

SEQ ID NO: 11853 - DNA, 500 bp, Homo sapiens
  misc_feature (44)..(45): n is a, c, g, or t
  misc_feature (76)..(76): n is a, c, g, or t
  misc_feature (82)..(82): n is a, c, g, or t
  misc_feature (118)..(118): n is a, c, g, or t
  misc_feature (150)..(150): n is a, c, g, or t
  misc_feature (454)..(455): n is a, c, g, or t
gggagccaacacttgaattcaacctttttacccaaaatcccatnntttttccactgagacaaatcctaggctcctnggaggnccctggcagaagccagaacacatggctgggcctttncagcccaacccactgtcttgcagtggacgganagccttggcgagggcagcagggtagagaggacaaagaatgtggggctggtttctgccctttaagagcacccggtcagtcagagaacagagatcacacacaccaaaccagacagaggcagggcagcatggagacaggtagacagacctccaggtccctaagctggggacagagaaggttctgagctgtcccatactcccactttgtgccaaatgactttgcacctgcaaatggtgcttcaatgtcgttttgtatctttaagctgtgatgttgtatatatacaatgcctcccagctagactgtaanncctttggggacaagggctgcttccagttcttggatggcgttctcc

SEQ ID NO: 11854 - DNA, 548 bp, Homo sapiens
aaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccgcgctgtcactgtcctcctgccagagaccctgggccagccactgccagacacggtgcaggacctggagagcaggtgggcccccactcagaaagaagcagggatatatcccaggaaagggaaacagacgcgacagcaacaagagcaccag

SEQ ID NO: 11855 - DNA, 432 bp, Homo sapiens
tcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagca

SEQ ID NO: 11856 - DNA, 501 bp, Homo sapiens
aacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtc

SEQ ID NO: 11857 - DNA, 502 bp, Homo sapiens
aagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacaggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatctt

SEQ ID NO: 11858 - DNA, 542 bp, Homo sapiens
  misc_feature (485)..(485): n is a, c, g, or t
gtgctgttgcttccagaaactaaagggaaagctttgcctgagaccatcgaggaagccgaaaatatgcaaagaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccgatctttgtatttttttaaatttgattcttttctttgcaatgctagcaaccagaatacataggggaactgtgggctaggcaaanaaaatagaaaaagtgtgaaaaacagtaaagttgggagaggagcatctattttcttaa

SEQ ID NO: 11859 - DNA, 497 bp, Homo sapiens
gattttccgtccagatgttccggtttgctggaaactatgacctagtctacctggactgtgaagtctatctctgtgacaccatgaatgaaaagtgcaagcctacctgctctgggaccagattccgaagtgggagtgtcatagatcaatcccgtgtcctgaacttgggtcccatcacacggaaaggtgtccaggccacagtctcaagggcttttagcagcttggggctcctgaaagtctggctgcctctgcttctctcggccaccttgaccctgacttttcagtgactgacagcggaaagccctgtgctccatggctgccatctcacctcctgctgggcagggggcatgatgcgggccagtgctccagccacagaaaagaaagttcatgctttgttcagcctgccttcttttctcccttttaatcctggctgtcgagaaacagcctgtgtctttaaatgctgctttttctcaaaatgggacttgtgacggtgtacctga

SEQ ID NO: 11860 - DNA, 507 bp, Homo sapiens
gcctgccatagaaaagtcacatccctgagggagacactctgtcctcattccctgcccttcctttggttgccatatggaatggccatggaatgcacgaagtcacaatgcaccatccatgagaagacagtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccgaagatgcagtcttctctccaatgatactaccaagtcttagttttcctcaaccacactcaatctttttgctccaccctgaattcctcacacctaaccctgatagttaccta

SEQ ID NO: 11861 - DNA, 477 bp, Homo sapiens
  misc_feature (41)..(41): n is a, c, g, or t
gctgctgcctgaaaagtatattaactagattagaagacacnatatactccaataaaatgaaatatattctattctcaatatataaactttaattgtactccctatcaaatattttgaaatttccatcacggcattactttgcatatttttttctaattaaatggttagtacagatgaaatctttatagatgactacttgaaaactaagtgctacaaattttcaaaccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgtttttctgatgaatggcttgatttttctccttgacatgttttgactgttcattctaactga

SEQ ID NO: 11862 - DNA, 122 bp, Homo sapiens
acaagtgaattataccccacagtcatcaggcaaacaggtatgggcgtaagtaacctgtggacccgcgtgggaagcatggtgtccccgctggtgaaaatcacgggtgaggtacagcccttcat

SEQ ID NO: 11863 - DNA, 530 bp, Homo sapiens
ggatcctcgatacagcacagagctcgggatgtatcagccccactgtgggctcgacagggtcctcatgtcctggggccatgatgagtacatgttccaggtgatgaagtttaacaagttctcactgccccctgaggctttctacatgatccgggtccacttcttttacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctgcagaggcctggccctgggcaaacagccgccatcagggttcacctcggtgggggaccccactcacccccttagggtcgccacccctcacggcaacttgtgcctggcgtcaataaagacctgg

SEQ ID NO: 11864 - DNA, 417 bp, Homo sapiens
gcccgaggctggaagtggtgtctgccttcaagggttaatccctctttgttccaagcagaagcattcttggcatcccagtgaagagctcaggccctcaggaagtgtcttgcttgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtat

SEQ ID NO: 11865 - DNA, 152 bp, Homo sapiens
cgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaac

SEQ ID NO: 11866 - DNA, 194 bp, Homo sapiens
gcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaag

SEQ ID NO: 11867 - DNA, 498 bp, Homo sapiens
taaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcatt

SEQ ID NO: 11868 - DNA, 470 bp, Homo sapiens
  misc_feature (61)..(61): n is a, c, g, or t
  misc_feature (82)..(82): n is a, c, g, or t
atcctctacagccagatgtcacagggatacgtctactttcacttggtgctggagaattcanaagtcaagaacatgctaagcntaagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaag

SEQ ID NO: 11869 - DNA, 449 bp, Homo sapiens
aggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctggggcctcttctgctttctcgggaattttcatctaggattttaagggaaggggaaggatagggtgatgttccgaaggtgaggagcttgaaacccgtggcg

SEQ ID NO: 11870 - DNA, 480 bp, Homo sapiens
ggcttccagctcatctagatgaggagctccaagccacactccacgactttagacatcaaatcctgcagacaaggggagccctcagtctgcagggctccataatgacggtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacaggg

SEQ ID NO: 11871 - DNA, 268 bp, Homo sapiens
  misc_feature (122)..(122): n is a, c, g, or t
  misc_feature (158)..(158): n is a, c, g, or t
gcagtggccactatggggtctgggctgccccttgtcctcctcttgaccctccttggcagctcacatggaacagggccgggtatgactttgcaactgaagctgaaggagtcttttctgacaanttcctcctatgagtccagcttcctggaattgcttgnaaaagctctgcctcctcctccatctcccttcagggaccagcgtcaccctccaccatgcaagatctcaacaccatgttgtctgcaacacatgacagccattgaagcctgtg

SEQ ID NO: 11872 - DNA, 554 bp, Homo sapiens
gacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttc

SEQ ID NO: 11873 - DNA, 457 bp, Homo sapiens
ccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcaatagaaaagtccacaacttccagatggaatgctctctgcaggccaagcccgcagtgcctacgtctaagctgggccaggcagaggggcgagatgcaggctcagcaccctccggaggggacccggccttcttgggcatggccgtgaacaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccaca

SEQ ID NO: 11874 - DNA, 399 bp, Homo sapiens
  misc_feature (234)..(241): n is a, c, g, or t
gcacctgctgctacatcatgaagatagctccagagagcatccccagtcttgaggctctcactagaaaagtccacaacttccaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccnnnnnnnngggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgc

SEQ ID NO: 11875 - DNA, 312 bp, Homo sapiens
  misc_feature (95)..(95): n is a, c, g, or t
  misc_feature (265)..(265): n is a, c, g, or t
gcatgtcacggtgggtggctgtgtctgagcacctccagcagatgtcactctgagtgtgggtgttggtgacatgcattgcacgggcctgtctcccngtttgtgtaaacatactagagtatactgcggcgtgttttctgtctacccatgtcatggtgggggagatttatctccgtacatgtgggtgtcgccatgtgtgccctgtcactatctgtggctgggtgaacggctgtgtcattatgagtgtgccgagttatgccaccctgtntgctcagggcacatgcacacagacatttatctctgcactcacatttt

SEQ ID NO: 11876 - DNA, 166 bp, Homo sapiens
gatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggag

SEQ ID NO: 11877 - DNA, 558 bp, Homo sapiens
caccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaatttttttttttttttttactggttatgggaagggagaaataaaatcatcaaaccccaa

SEQ ID NO: 11878 - DNA, 539 bp, Homo sapiens
gaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagccca

SEQ ID NO: 11879 - DNA, 427 bp, Homo sapiens
ctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcc

SEQ ID NO: 11880 - DNA, 499 bp, Homo sapiens
  misc_feature (217)..(217): n is a, c, g, or t
acagggacaagtacagcacctccaggctgctttctctcagtataagaaagttgagctcttcccaaatggccaaagtgtcggggagaagattttcaagacagcaggctttgtaaaaccatttacggaggcacagctgctgtgcacacaggctggtggacagttggcctctccacgctctgccgctgagaatgccgccttgcaacagctggtcgtagcnaagaacgaggctgctttcctgagcatgactgattccaagacagagggcaagttcacctaccccacaggagagtccctggtctattccaactgggccccaggggagcccaacgatgatggcgggtcagaggactgtgtggagatcttcaccaatggcaagtggaatgacagggcttgtggagaaaagcgtcttgtggtctgcgagttctgagccaactggggtgggtggggcagtgcttggcccaggagtttggccagaagtcaaggcttagaccctcatgct

SEQ ID NO: 11881 - DNA, 476 bp, Homo sapiens
gaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagattttgattgaaagtcctagggtgattctatttctgctgtgatttatctgctgaaagctcagctggggttgtgcaagctagggacccattcctgtgtaatacaatgtctgcaccaatgct

SEQ ID NO: 11882 - DNA, 383 bp, Homo sapiens
catcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatc

SEQ ID NO: 11883 - DNA, 586 bp, Homo sapiens
gacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttctta

SEQ ID NO: 11884 - DNA, 449 bp, Homo sapiens
ccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcaatagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgaacaccctgtgtggcgaggtgccgctctactacatctaggacgcctccgggtcagtggaagccccaacgggaaaggaaacgccccgggcaaagggtcttttgcagcttttgcagacgggcaagaagctgcttctgcccaca

SEQ ID NO: 11885 - DNA, 469 bp, Homo sapiens
agcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaa

SEQ ID NO: 11886 - DNA, 295 bp, Homo sapiens
  misc_feature (125)..(125): n is a, c, g, or t
  misc_feature (187)..(188): n is a, c, g, or t
  misc_feature (201)..(201): n is a, c, g, or t
  misc_feature (215)..(215): n is a, c, g, or t
  misc_feature (219)..(220): n is a, c, g, or t
  misc_feature (231)..(232): n is a, c, g, or t
  misc_feature (234)..(234): n is a, c, g, or t
  misc_feature (240)..(240): n is a, c, g, or t
  misc_feature (246)..(246): n is a, c, g, or t
  misc_feature (248)..(248): n is a, c, g, or t
tgcctacgtctaagctgggccaggcagaggggcgagatgcaggctcagcaccctccggaggggacccggccttcctgggcatggccgtgaacaccctgtgtggcgaggtgccgctctactacatntaggacgcctccggtgagcaggtgtgatcccagggcccctgatcagcagcggaggagcgctnnggccacctgcccnggctgtggaggagngctnncgctgaccagnngntggggngtccantnaagcggggtcatccaggcaactcgggggaggggaagctcacagaccg

SEQ ID NO: 11887 - DNA, 470 bp, Homo sapiens
  misc_feature (58)..(58): n is a, c, g, or t
  misc_feature (60)..(60): n is a, c, g, or t
  misc_feature (79)..(79): n is a, c, g, or t
  misc_feature (81)..(105): n is a, c, g, or t
  misc_feature (127)..(127): n is a, c, g, or t
  misc_feature (193)..(193): n is a, c, g, or t
  misc_feature (209)..(209): n is a, c, g, or t
  misc_feature (254)..(254): n is a, c, g, or t
  misc_feature (256)..(261): n is a, c, g, or t
  misc_feature (263)..(263): n is a, c, g, or t
  misc_feature (266)..(269): n is a, c, g, or t
  misc_feature (271)..(271): n is a, c, g, or t
  misc_feature (377)..(377): n is a, c, g, or t
  misc_feature (427)..(428): n is a, c, g, or t
acctgctgctacatcatgaagatagctccagagagcatccccagtcttgaggctctcnantagaaaagtccacaacttncnnnnnnnnnnnnnnnnnnnnnnnnncaagcccgcagtgcctacgtcntaagctgggccaggcagaggggcgagatgcaggctcagcaccctccggaggggacccggccttccntgggcatggccgtgancaccctgtgtggcgaggtgccgctctactacatctaggacgcctncnnnnnncnggnnnncngggtcagtggaagccccaacgggaaaggaaacgccccgggcaaagggtcttttgcagcttttgcagacgggcaagaagctgcttctgcccacaccgcagggacaanccctggagaaatgggagcttggggagaggatgggagtgggcagaggtggnncccaggggcccgggaactcctgccacaacagaataaagcagc

SEQ ID NO: 11888 - DNA, 383 bp, Homo sapiens
ccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgc

SEQ ID NO: 11889 - DNA, 209 bp, Homo sapiens
gaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgt

SEQ ID NO: 11890 - DNA, 493 bp, Homo sapiens
ggtgtatcccttatttggacactatgggagattccagtttaatgcctttaaattcttgagaagtatgagctccgcgtgtctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatat

SEQ ID NO: 11891 - DNA, 550 bp, Homo sapiens
tgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacgagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaa

SEQ ID NO: 11892 - DNA, 503 bp, Homo sapiens
gacagtctctaaggccatgaccgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccagttccatgccctccacaggggactctgaggccactcccatctcccccgacaggcaactccgagtctgcccccgtccctgcaacgggtgactctcaggatgcccctgtgcccctcacaagtgactctgaggctcccccgtaccctacgggtgactctgaggcccgtgcccaccttgggtgacactgaggctgcccctgtgtcccccacagatgactccgaggaagctcagatgctgcagtcattagtttctagtgtcccatcagc

SEQ ID NO: 11893 - DNA, 434 bp, Homo sapiens
caatgcggccaagatcatccgccaccctaaatacaacagggacactctggacaatgacatcatgctgatcaaactctcctcacctgccgtcatcaatgcccgcgtgtccaccatctctctgcccaccgcccctccagctgctggcactgagtgcctcatctccggctggggcaacactctgagctttggtgctgactacccagacgagctgaagtgcctggatgctccggtgctgagggaggctgagtgtaaagcctcctgccctggaaagattaccaacagcatgttctgtgtgggcttccttgagggaggcaaggattcctggaagcgtgactctggtggccctgtggtctgcaacggacagctccaaggagttgtctcctggggccatggctgtgcctggaagaacaggcctggagtctacaccaaggtct

SEQ ID NO: 11894 - DNA, 257 bp, Homo sapiens
aagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgt

SEQ ID NO: 11895 - DNA, 557 bp, Homo sapiens
actgggaccatctagcacatagccaaaggggctgacctaatggggcaggtctgacacaaatggggtcatttcttggacagacatcccaagggccactatgatagtagcttctctaaaagacgggttcctgagaagaattgcattctgtttcccagtgagttagcggagtcatacttactacatcccaaggcaggtggcatggtagaaacaggcctgaaagagaggtcaggttctaaccttctcccctctctgaggctcagctgctcccttctgtagaataaaaggggttggtctgtaacaagattttcaaaaatttatagtagtgaaactttacaattcgacttggacaaccagagattaaaagcaaatagattcttgttgatgtcaggtggggagcttagctctcccattctgtgattccttcctctgaaggccctcaaagcaactccataataactcacagagctgccagagccgatgttttggagcaccctgagacatatgaactctaatataacttccaggagaaagtacataggattccacttagagccaat

SEQ ID NO: 11896 - DNA, 434 bp, Homo sapiens
caatgcggccaagatcatccgccaccctaaatacaacagggacactctggacaatgacatcatgctgatcaaactctcctcacctgccgtcatcaatgcccgcgtgtccaccatctctctgcccaccgcccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtct

SEQ ID NO: 11897 - DNA, 305 bp, Homo sapiens
  misc_feature (89)..(89): n is a, c, g, or t
  misc_feature (91)..(91): n is a, c, g, or t
  misc_feature (131)..(131): n is a, c, g, or t
  misc_feature (134)..(134): n is a, c, g, or t
  misc_feature (188)..(188): n is a, c, g, or t
tctctcagtgctgcaccatcagtggcctgaagaaggtcaaagtacagctgcagtgtgtggggagccggagggaggagctcgagatcttnanggccagggcctgccagtgtgacatgtgtcgcctctctcgntantagcccatcctctcccctccttcctcccctgggtcacagggcttgacattctgntgggggaaacctgtgttcaagattcaaaaactggaaggagctccagccctgatggttacttgctatggaatttttttaaataaggggagggttgttccagctttgatcctttgtaag

SEQ ID NO: 11898 - DNA, 89 bp, Homo sapiens
tgactccaaggaagctcagatgcctgcagtcattaggttttagcgtcccatgagccttggtatcaagaggccacaagagtgggacccca

SEQ ID NO: 11899 - DNA, 535 bp, Homo sapiens
gatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcctacagtgttcactcgagtctccgccttcatcgactggattgaggagaccatagcaagccactagagccaaggcccagctggc

SEQ ID NO: 11900 - DNA, 563 bp, Homo sapiens
  misc_feature (238)..(238): n is a, c, g, or t
  misc_feature (251)..(251): n is a, c, g, or t
caaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacntctgcagcaggtngctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccct

SEQ ID NO: 11901 - DNA, 407 bp, Homo sapiens
  misc_feature (179)..(179): n is a, c, g, or t
  misc_feature (209)..(209): n is a, c, g, or t
aggtcctgaagatcgccaagtttttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggntggggcaagaccaagtacaacgggtgactntggaggccccctggtctgccagaaggacggagcctggaccctggtgggcattgtgtcctggggcagccgcacctgctctaccaccacgcccgctgtgtacgcccgtgtcaccaagctcataccctgggtgcagaagatcctggccgccaactgagcccgcagctcctgccacccctgccttaagatttcccattaaat

SEQ ID NO: 11902 - DNA, 374 bp, Homo sapiens
ccacacagggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctcagcttggcgtgcagctcatcatggacatgagaccagtgtgaagactcaccctggaagagaatattctccccaaactgccctacctgactaccttgtcatgatcctccttctttttcctttttcttcaccttcatttcaggcttttct

SEQ ID NO: 11903 - DNA, 526 bp, Homo sapiens
gtgcctcctacgatgagtttcaggagagtaagtgtttcccttgtccagctgaaggatgccccaaaatggggcactatgctgaccaatttaaggggaaaacaagtgctgtggaacaaacctttttcctgaacacaggagagagtggtaactttactagttggagatataaggtatcagtcacactttctggaaaagagaaagtgaatgggtacatcaggattgctttgtatggaagtaatgaaaactcgaaacaatatgagattttcaaaggatccctcaaaccagatgcaagtcacacgtgtgctattgatgtggattttaatgttggaaaaatacagaaagttaaattcctctggaacaaacgtgggataaatctatctgagcccaaactgggggcttcccaaatcacagtgcaaagtggtgaagatgggactgagtataatttttgtagcagcgacactgtggaagaaaacgtcttgcaatctctttacccttgttaaaaacgtggtgcggctattgcggtaat

SEQ ID NO: 11904 - DNA, 500 bp, Homo sapiens
gaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacaccca

SEQ ID NO: 11905 - DNA, 514 bp, Homo sapiens
tggatctagcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctg

SEQ ID NO: 11906 - DNA, 555 bp, Homo sapiens
tccccatctagaactgccattatcagtggagtagtgggtccctggtctcctacaaatcctgggacattggatccccaagctgtgccaatactgcctactgtgctagcctgacttcaagctcaggtgagaggcacagaatccacacacttattgccatcctctcctatttatctctgaggatcgaccggggactgggatagaggaagggtgagctcctcattcaggaaatagaggagtgtttcctctttatttttgctgagtcctgcagccaggagggtaatacactctgatcccctcagtctgaatcttctcattgtcttataggattcaagaaatggaaggatgattcttgtaaggagaagttctcctttgtttgcaagttcaaatactggaggcaattgtaaaatggacgtctagaattggtctaccagttactatggagtaaaagaattaaactggaccatctctctccatatcaatctggaccatctctcctctgctaaatttgcatgactgatctttagtatctttacctacctcaatttctggagccct

SEQ ID NO: 11907 - DNA, 568 bp, Homo sapiens
ctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagccctggcctctctctacgggaccaagttcaactatggcagcatcatcaaggcaatttatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtaccaggaacagaa

SEQ ID NO: 11908 - DNA, 371 bp, Homo sapiens
  misc_feature (150)..(158): n is a, c, g, or t
tggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagnnnnnnnnnatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttg

SEQ ID NO: 11909 - DNA, 487 bp, Homo sapiens
cacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaa

SEQ ID NO: 11910 - DNA, 448 bp, Homo sapiens
ccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactacgtgaaatggattaagaacaccatagct

SEQ ID NO: 11911 - DNA, 95 bp, Homo sapiens
gactccaaggaagctcagatgcctgcagtcattaggttttagcgtcccatgagccttggtatcaagaggccacaagagtgggaccccaggggctc

SEQ ID NO: 11912 - DNA, 558 bp, Homo sapiens
gatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatg

SEQ ID NO: 11913 - DNA, 126 bp, Homo sapiens
gaccaagtacaacgccaacaagacccctgacaagctgcagcaggcagccctgcccctcctgtccaatgccgaatgcaagaagtcctggggcaggaggatcaccgacgtgatgatctgtgccggggc

SEQ ID NO: 11914 - DNA, 414 bp, Homo sapiens
ctgtcccactcaccatggagaagatcctgatcctcctgcttgtcgccctctctgtggcctatgcagctcctggcccccgggggatcattatcaacctggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcat

SEQ ID NO: 11915 - DNA, 545 bp, Homo sapiens
cccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggagaccatagcaagccactagaaccaaggcccagctggcagtgctgatcgatc

SEQ ID NO: 11916 - DNA, 521 bp, Homo sapiens
gaagacccggtccaaggtatctggaagcctctgtgttggtgtggatcctaaccggaactgggatgcaggttttggaggacctggagccagcagcaacccttgctctgattcataccacggacccagtgccaactctgaagttgaagtgaaatccatagtggacttcatcaagagtcatggaaaagtcaaggccttcattatcctccacagctattcccagctgctgatgttcccctatgggtacaaatgtaccaagttagatgactttgatgagctgagtgaagtggcccaaaaggctgcccaatctctgagaagcctgcatggcaccaagtacaaagtgggaccaatctgctctgtcatctaccaagccagtggaggaagcattgactggtcctatgattatggcatcaagtactcatttgcctttgaactgagagacacagggcgctacggcttcctcttgccagcccgtcagatcctgcccacagccgaggagacctggcttggcttgaaggcaatca

SEQ ID NO: 11917 - DNA, 568 bp, Homo sapiens
aggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggtacggggtggagcccgcggtcctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgc

SEQ ID NO: 11918 - DNA, 516 bp, Homo sapiens
acaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggca

SEQ ID NO: 11919 - DNA, 491 bp, Homo sapiens
gactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcct

SEQ ID NO: 11920 - DNA, 506 bp, Homo sapiens
gagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctacgccacccccactgaagacaaggctgaccttgtgaagtatttcatcatcagaaacagctgctcaaatcagcgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgc

SEQ ID NO: 11921 - DNA, 448 bp, Homo sapiens
cacttgcgccaagctctatgacaagagcgacccctactatgagaactgctgcgggggcgccgagctgtcgctggagtcgggcgcagacctgccctacctgccctccaactgggccaacaccgcctcctcacttgtggtggccccgcgctgcgagctcaccgtgtggtcccggcaaggcaaggcgggcaagacgcacaagttctctgccggcacctacccgcgcctggaggagtaccgccggggcatcttaggagactggtccaacgctatctccgcgctctactgcaggtgcagctgatgcattgctggtctctcatctgcagcttccacagagtgccaagcccctcactcagcccatccctgggctctgctccggggccccaagacccaggaggaggagcgttctgcctgccccctcccacctcccctgcaatacagcctttgtgca

SEQ ID NO: 11922 - DNA, 594 bp, Homo sapiens
  misc_feature (166)..(166): n is a, c, g, or t
taaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaangatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaa

SEQ ID NO: 11923 - DNA, 561 bp, Homo sapiens
gtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaag

SEQ ID NO: 11924 - DNA, 217 bp, Homo sapiens
ctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatc

SEQ ID NO: 11925 - DNA, 379 bp, Homo sapiens
gaagaggccatcaagcacatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgc

SEQ ID NO: 11926 - DNA, 504 bp, Homo sapiens
gcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttggggctctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtgga

SEQ ID NO: 11927 - DNA, 519 bp, Homo sapiens
aagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagcatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcac

SEQ ID NO: 11928 - DNA, 543 bp, Homo sapiens
  misc_feature (29)..(29): n is a, c, g, or t
  misc_feature (31)..(31): n is a, c, g, or t
  misc_feature (61)..(61): n is a, c, g, or t
  misc_feature (69)..(69): n is a, c, g, or t
  misc_feature (72)..(72): n is a, c, g, or t
  misc_feature (84)..(84): n is a, c, g, or t
  misc_feature (94)..(94): n is a, c, g, or t
  misc_feature (99)..(99): n is a, c, g, or t
  misc_feature (101)..(101): n is a, c, g, or t
  misc_feature (132)..(132): n is a, c, g, or t
  misc_feature (173)..(174): n is a, c, g, or t
  misc_feature (180)..(181): n is a, c, g, or t
  misc_feature (195)..(196): n is a, c, g, or t
  misc_feature (213)..(213): n is a, c, g, or t
  misc_feature (220)..(220): n is a, c, g, or t
  misc_feature (240)..(241): n is a, c, g, or t
  misc_feature (245)..(245): n is a, c, g, or t
  misc_feature (260)..(260): n is a, c, g, or t
  misc_feature (276)..(276): n is a, c, g, or t
  misc_feature (282)..(282): n is a, c, g, or t
  misc_feature (286)..(286): n is a, c, g, or t
  misc_feature (291)..(291): n is a, c, g, or t
  misc_feature (297)..(297): n is a, c, g, or t
  misc_feature (315)..(316): n is a, c, g, or t
  misc_feature (320)..(320): n is a, c, g, or t
  misc_feature (329)..(329): n is a, c, g, or t
  misc_feature (339)..(339): n is a, c, g, or t
  misc_feature (341)..(341): n is a, c, g, or t
  misc_feature (361)..(361): n is a, c, g, or t
  misc_feature (376)..(376): n is a, c, g, or t
  misc_feature (381)..(381): n is a, c, g, or t
  misc_feature (438)..(438): n is a, c, g, or t
  misc_feature (450)..(451): n is a, c, g, or t
  misc_feature (466)..(466): n is a, c, g, or t
  misc_feature (489)..(489): n is a, c, g, or t
  misc_feature (498)..(498): n is a, c, g, or t
gtggtgtcagcagctcactgctacaagtncngcatccaggtgagactgggagagcacaacntcgaagtnctngaggggaatgancagttcatcnatgcngncaagatcatccgccaccccaaatacaacagntggactctggacaatgacatcctgctgatcaagctctccanncctgcnntcatcaatgcccanntgtccaccatctctctncccaccncccctccagctgctggcacnnagtncctcatctctggctngggcaacactctgagntctggngccnactanccagangagctgcagtgcctggannctcntgtgctganccaggctgantntgaagcctcctaccctgganagattaccaacaacntgttntgtgtgggtttccttgagggaggcaaggattcctgccagggtgactctggtggcccngtggtctgcaanngacagctccaagganttgtctcctggggctatggctgngcccagaanaacaggcctggagtctacaccaaggtctacaactatgtggactgg

SEQ ID NO: 11929 - DNA, 324 bp, Homo sapiens
  misc_feature (252)..(254): n is a, c, g, or t
  misc_feature (256)..(257): n is a, c, g, or t
  misc_feature (288)..(288): n is a, c, g, or t
catgtcagcagtgtttggtcgtccacatgcttgtcagccccacgctgtgctcctgcgtctcttcccgtctcatccatctggatgcttgacacctctgacagcatccctttcctgtcatcttagggcagcttcaggaaaccgaaaaacaggcttgtgtccttccattaacccctttatccacaagttcagtatcagcatgagccctggggagctccaaggctgcagccaggagccccgtagccagggatggtnnngnnctgtgctgctgcaccagggccgccttccccnccttttccagaggaacctgttctacggccagaagaa

SEQ ID NO: 11930 - DNA, 454 bp, Homo sapiens
tctctgcatcactttatgcactcaagaaatctttacatattaggtaactttatgcaattaaaatgcttctcttcacaaaaattaaaatgcctttccatgtttccgcactacatttgcacactgaagcaaccacatttgctgttagaaaagtactcctactacctaatttctggttaaaccaaggcctgatgttttctgcttccatttgtagtgagggtactttgtatcctataagcgagggactataggggtttctttgttcaaatttttcccacatccctgagaggctgacatgtgttgctgtgaccacttaattgatcccagcactttgggaggccaaggtggatggatcacctgaggtcaggagttcgagaccagcctggcgaacatggtgaaaccctatctctactaatgatacaaaaatcagcctgttgtggtggcaggctcttgtagt

SEQ ID NO: 11931 - DNA, 345 bp, Homo sapiens
gtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttcta

SEQ ID NO: 11932 - DNA, 178 bp, Homo sapiens
gctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagcc

SEQ ID NO: 11933 - DNA, 496 bp, Homo sapiens
ccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgatgtgaaggtcgtggagttgcccacccaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgt

SEQ ID NO: 11934 - DNA, 410 bp, Homo sapiens
ttatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttccatgtggcagatctacatgtctagagaacactgtgctctattaccattatggataaagatgagatggtttctagagatggtttctactggctgccagaatctagagcaaagccatcccccctcctggttggtcacagaatgactgacaaagacatcgattgatatgcttctttgtgttatttccctcccaagtaaatgtttgtccttgggtccattttctatgctt

SEQ ID NO: 11935 - DNA, 499 bp, Homo sapiens
  misc_feature (319)..(319): n is a, c, g, or t
ctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggntgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatg

SEQ ID NO: 11936 - DNA, 502 bp, Homo sapiens
tgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctagg

SEQ ID NO: 11937 - DNA, 265 bp, Homo sapiens
tggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcc

SEQ ID NO: 11938 - DNA, 444 bp, Homo sapiens
tgctatggcaaccatctttcagccccactggtcttttcatgctctctcctgccttcccttgtccttccctgagttcctccagggagactaggttattctctgccatagagctaactgggtctatatgctgggtgctgagacactgatccccctcatttgatgagcaaatgagctacttttccctagacaccaggccagctctctcttatctgacttctgtttcttatcccataacttacttgtatctattatgtgtcacttccaacactctccatactcattcttgtgattctcctctagccatatatatgggccccatcactgttctgttccctccatctatgcacaagctttaccccactctctctaaacctgtaactttctgactgtcctgtccttggccagaaggaagggagaatactgtgtttgggactgtatctcagc

SEQ ID NO: 11939 - DNA, 518 bp, Homo sapiens
ccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgactgacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgc

SEQ ID NO: 11940 - DNA, 464 bp, Homo sapiens
tctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccg

SEQ ID NO: 11941 - DNA, 570 bp, Homo sapiens
gggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaa

SEQ ID NO: 11942 - DNA, 396 bp, Homo sapiens
tgtgcggagcttcagtctggtagccacgaggagtggtgaccccattgccaatgcagtggctgacatgttgcgtgagaatcgtagcctccagagcctaaacatcgaatccaacttcattagcagcacaggactcatggctgtgctgaaggcagttcgggaaaatgccacactcactgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctggg

SEQ ID NO: 11943 - DNA, 460 bp, Homo sapiens
  misc_feature (38)..(38): n is a, c, g, or t
  misc_feature (323)..(324): n is a, c, g, or t
  misc_feature (358)..(358): n is a, c, g, or t
tacactggtgtaggcctgtactgctggtggggctgggnccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacanncagcgtgcacccagacgctggtgccatggcgaancaggcgttcaagaccatggagaagacaactcctcatctagaaaatgaggacacctcagtgacaaacacacctttttataccaatcagtatcctctgttcatt

SEQ ID NO: 11944 - DNA, 460 bp, Homo sapiens
ggcacactagctgtactgtgtccgaccttatcgtgggcaatgaatactatttccgagtttacaccgagaacatctgtgggctcagtgactcacctggtgtctccaagaacacggcccgcatcctcaagacaggaatcaccttcaaaccgttcgagtataaggagcatgacttccggatggctcccaagttcctgacacctctcatagaccgcgtggtcgtggctgggtactcggcagccctcaactgtgctgtcagaggccacccgaagccgaaggtggtctggatgaagaacaagatggaaatccgtgaagatcccaagttcctgataaccaattaccaaggagtcctgacgctgaacatccgtcgcccctcgcccttcgacgctgggacttacacctgccgggccgtcaacgagctgggcgaggcgctggctgagtgcaagctggaggtccgagtgcc

SEQ ID NO: 11945 - DNA, 508 bp, Homo sapiens
gagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactaggg

SEQ ID NO: 11946 - DNA, 527 bp, Homo sapiens
ttgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctc

SEQ ID NO: 11947 - DNA, 395 bp, Homo sapiens
agaagcgcaatgttgaagctgtcaagggtctacgcaaacatgagagaaaagtgaaggaactcacttaccaaactgaggaagaccgcaagaatattctcaggctgcaggacctggtggacaagctgcaagcaaaggtgaaatcctacaagagacaagctgaagaagcggaggaacaatccaacgtcaacctctccaaattccggaggatccagcacgagctggaggaggccgaggaaagggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttat

SEQ ID NO: 11948 - DNA, 341 bp, Homo sapiens
  misc_feature (47)..(47): n is a, c, g, or t
  misc_feature (49)..(49): n is a, c, g, or t
  misc_feature (253)..(253): n is a, c, g, or t
ggataatgttataccccggactatgaaaaaagctggtggtaaatggnangaatgtgaaattttaaactgctctcaacgtaggaatcttggtggaaaagttcctacctgaggtctgatatgattcaattatagaatgcaatgagcttggccaaggggactttgaatccagccaaggaaactttgaatctcgacagctctgagaatcacattttcagtgcattgaatatggagtaaactatttagacaaggattntgtgagactaggctacttacctttaattgccagcatttgtaaatgattgtgcaatcttgtgtaatggtcttttattttgactgttttg

SEQ ID NO: 11949 - DNA, 405 bp, Homo sapiens
tgcctttcttccatcgtggacagtatttcctcggaggaacgcaaactcccctgcgtggaggaagtggtggagaagtaactgagcctgcgcttgagaccttctccacgcagcaggaagatcccaccgacccttcctggcctaatcctttagattaggtcacattacattaacatttaggaacccagaccgaaaagttgctgaaagggaaggagacacattcacaaagaaaagttgcgaaaattgcgaaatctgttgtgcacgctcaaatgaaaacgcctttcggctttgggcttttatttttttggaactgcgagtggcttaggtctagcctcattttgtttttgtttggttggttttatactatattaacttttattacggtgatccttttgtgccatgttcaaa

SEQ ID NO: 11950 - DNA, 512 bp, Homo sapiens
tcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgctt

SEQ ID NO: 11951 - DNA, 467 bp, Homo sapiens
cttccgctacatggcaatcgggggctatgtgggtgcagccaccgtgggagcagctgcctggtggttcctgtacgctgaggatgggcctcatgtcaactacagccagctgactcacttcatgcagtgcaccgaggacaacacccactttgagggcatagactgtgaggtcttcgaggcccccgagcccatgaccatggccctgtccgtgctggtgaccatcgagatgtgcaatgcactgaacagcctgtccgagaaccagtccctgctgcggatgccaccctgggtgaacatctggctgctgggctccatctgcctctccatgtccctgcacttcctcatcctctatgttgaccccctgccgatgatcttcaagctccgggccctggacctcacccagtggctcatggtcctcaagatctcactgccagtcattgggctcgacgaaatcctcaagttcgttgctcgga

SEQ ID NO: 11952 - DNA, 535 bp, Homo sapiens
ccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggtttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtgggactaggtgcagacttttgccttcttggagtcctgggtctcctctgagaggtctgggtggtgctcctcctacgcctctagaggtctctgtgttcctcattttccttcaaaagcgggc

SEQ ID NO: 11953 - DNA, 345 bp, Homo sapiens
gggattggcagcggctgcatcatcagtggcgggggctccgtctgcggaggtggttcctctggaggcggcggcggcggctcctccgtgggtggctccgggagtggcaagggcgtcccgatctgccaccagacccagcagaagcaggcgcctacctggccgtccaaatagatcccccagggtaccacggaggcgaaggagttggaggtgttttccaggggcaccgatgggcttagagctctcatgatgctacccgaggtttgcaaatccttcatgtcttaacctacctggaagaagccattgagctctccggctgcatctagttctgctgtttagcctctttggttt

SEQ ID NO: 11954 - DNA, 416 bp, Homo sapiens
tcaagtcctctggtggcagttccagcgtgaggtttgtttctaccacttattccggagtaaccagataaagagatgccctctgtttcattagctctagttctcccccagcatcactaacaaatatgcttggcaagaccgaggtcgatttgtcccagccttaccggagaaaagagctatggttagttacactagctcatcctattcccccagctctttcttttctgctgtttcccaatgaagttttcagatcagtggcaatctcagttcccttgctatgaccctgctttgttctttcccgagaaacagttcagcagtgaccaccacccacatgacatttcaagcaccaccttaagccagccagagtaggaccagttagacctagggtgtggacagctccttgcatcttaacactgtgc

SEQ ID NO: 11955 - DNA, 484 bp, Homo sapiens
  misc_feature (190)..(190): n is a, c, g, or t
  misc_feature (420)..(420): n is a, c, g, or t
  misc_feature (424)..(424): n is a, c, g, or t
tgggatttagtcagtcacagagatactattactatgagtaagaaattaatggcaaaggaattaatccaagaatagaagaatgaagcaagttcactttcaatcaagaaacttcataatactttcagggaagttatcttttcctgtcaatctgtttaaaatatgctatagtatttcattagtttggtggtancttatttttattgtgtaatgatctttaaacgctatatttcagaaatattaaatggaagaaatcaatatcatggagagctaactttagaaaactagctggagtattttaggagattctgggtcaagtaatgttttatgtttttgaaagtttaagttttagacactccccaaatttctaaattaatctttttcagaaatatcgaaggagccaaaaatataaaacagttctgnatanccaaagtggctatatcaacatcagggctagcacatctttctctattatccttctattgga

SEQ ID NO: 11956 - DNA, 229 bp, Homo sapiens
aattattgacaaacctatccaaggagctaaatgacgtggtttaggagccaaaacgtctctagaaacattataacacatcccatcctgaacaaagaatgttgtcatagtttcccacatgaatattcagaatatttgcatctttttgtgtcactactggaattctgtacaattatatttaaatttattgtcatggccttctggatataggatccagaaaattgtacttcat

SEQ ID NO: 11957 - DNA, 481 bp, Homo sapiens
ggtgaccacaatagcaacacctccctattctgttatttcttagtgtaggtagacaattctttcaggagcagagcagcgtcctataatcctagaccttttcatgacgtgtaaaaaatgatgtttcatcctctgattgccccaataaaaatctttgttgtccatccctatacaacctgccaacatggttgacatttaatgagaggaatgtcaaaaatacattttactttattcaaagaaaaatatattggttactgggaaaaggtcaagaaagaggcagaaagagatcagggagggctaaagttgtgtcttatgccaagcggaagtggaaaatatcacttttcactttatcaactgagactttggggcctgtaagcttgaggcaagacagaaataagagaatcaagacttgattgtaaaaattgacaactttagattctgaggctaggctgagtacttattatacggctacatttacacattt

SEQ ID NO: 11958 - DNA, 466 bp, Homo sapiens
gaggcagtgctgtgtggttcctgccgtccggactctttttcctctactgagattcatctgtgtgaaatatgagttggcgaggaagatcgacctattattggcctagaccaaggcgctatgtacagcctcctgaagtgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggaggtggacccgccaaatccagaggaggtgaaaacgcctgaagaaggtgaaaagcaatcacagtgttaaaagaagacacgttgaaatgatgcaggctgctcctatgttggaaa

SEQ ID NO: 11959 - DNA, 418 bp, Homo sapiens
attatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgt

SEQ ID NO: 11960 - DNA, 434 bp, Homo sapiens
gactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctattttgga

SEQ ID NO: 11961 - DNA, 446 bp, Homo sapiens
  misc_feature (120)..(120): n is a, c, g, or t
  misc_feature (301)..(302): n is a, c, g, or t
gcatctgtggcttaacacttgtgagagttaccagcttgaaaatgatggtgttgactacctcttgaatcacatctatcaaccactggcacctaccaccaagctggcttcaattagtatgtngttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgnntgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtca

SEQ ID NO: 11962 - DNA, 436 bp, Homo sapiens
gactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaa

SEQ ID NO: 11963 - DNA, 283 bp, Homo sapiens
tgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcaga

SEQ ID NO: 11964 - DNA, 403 bp, Homo sapiens
  misc_feature (276)..(276): n is a, c, g, or t
  misc_feature (298)..(298): n is a, c, g, or t
gtttctcctacggttaattcttcaggatgcagcccggaggaacgtggatttgacttaaagaagtaaagagcatcgtattaccgtttctatgagcgcattttaagagatgttcggtgtttgtagatcccatccatccggctgctaggggtaaggtgctgttttatgtgaagatagttctgtaaagttgtttcagttaaactgggctgagagagcttgaaagtccttttcataaaagataactatttccttttcttgttgaataccttagaatagttntccccccctttttttttttttnaacaaaaaaacacttttctaaggactgaagattggcaaaaactaaaataaattaaaactgcttacaccagaagccttttagagaagcatgagactgtttgactag

SEQ ID NO: 11965 - DNA, 263 bp, Homo sapiens
gacagcataaagattgcagcttttttgttaactttaggactggtggatggttggtgtcatttactaaaatggggaggatttgaggtgaaaaaattttaggtgaagagaataatgctgagttttaggcaactattaaaatgtccattctgtagattagaggtgatgtcaggacataaatgaggttaatgtaatattacatattgatagaggaataggtcaatagagaagatacaaaagagtggttaggtgcatagatttttgaa

SEQ ID NO: 11966 - DNA, 264 bp, Homo sapiens
tgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaag

SEQ ID NO: 11967 - DNA, 513 bp, Homo sapiens
gtctgagccagagttgtagccaggccttgcactactgccatagccaatcaatctcccaaagccaagtttacctgctgttctcacccccaatgaggtcttaggcagattctttactttgtaattcaaaaggcctgttaacctttgttcttgttatgcatgaataacttgttgactttttttttttctctttttcaactagtgtttcaacaggtttatttagattcagaatgtaaatttacaaatgatatagatcaccctgttattgctgtttttcagggacagtagaaagtgttttgttttttgagtgaaacaacttattaataaaaatccttaaatcacttttgtaatccaggacaagaaaatgtggcattagagtagaaatatctttggaaatgtgaaagaccccatagtgaaatatttgggatcagaagccagaggtgtaaaagtggtcaattcttggtttacttcatttaatctttcttttcataaagatacatacctggatttgtttat

SEQ ID NO: 11968 - DNA, 411 bp, Homo sapiens
  misc_feature (63)..(63): n is a, c, g, or t
  misc_feature (70)..(70): n is a, c, g, or t
  misc_feature (100)..(100): n is a, c, g, or t
  misc_feature (280)..(280): n is a, c, g, or t
taaaaaatcctgtactgcccatgtctggtacagaagtatgtatagaattgtagagaaaatgancactttngggatgatttgaaagcaaattacagaactnaccagtttcaccactttaaaacttttggggaatggccatttagatataacctggtgcagtcaggtaaccccaaacagagtttttaaaagtttccacacccttctttgctggtgcctgccctgcatcatgctgtcgctgtgaggagggacttgttccagatctctggggcagcccgagtgnctcacctaaagtcacacagcttccacggaacattactggaagctcagtgagggccttctgcctctgaaacttgctctatttccctcaagtcctgcttccttttgtaggtttaagacattagttcctgagaa

SEQ ID NO: 11969 - DNA, 438 bp, Homo sapiens
  misc_feature (56)..(56): n is a, c, g, or t
  misc_feature (229)..(229): n is a, c, g, or t
  misc_feature (406)..(406): n is a, c, g, or t
agccctgttgatcactggacataaagcttcttttccccaataattcttctttactnaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttnatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgcctttntgtcatgtgtttctctcctgtgacatttcaaa

SEQ ID NO: 11970 - DNA, 409 bp, Homo sapiens
ttaacttcattttgtatcttgcttaagtagcaggctcactaaaattagagaaagtccaataactctccccctttcccttgagaaatctttaagtttcgattctggagcaaaaactttcagcattaaatatttcagaggctccattcacagctttcagataaactggagtgttcagatggactgttttaataaaaatctttgagcaagtgagttatggcaagagaaactcagcctctttctgtataaacttaacagggaagggctggggtgtgaaaaagaagattgtatgaaaaccattggtaatttttattttttatttttgggactgcactatcctgttcacgaagacatgtgaacttggttcagtccaaatggggatttgtataaaccagtgctctccattagaaat

SEQ ID NO: 11971 - DNA, 471 bp, Homo sapiens
aaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagccc

SEQ ID NO: 11972 - DNA, 403 bp, Homo sapiens
ttatttgacagatctctattctataaatgtgtaatgtgatgaagaaagagatctttcttttttaatgaaaacattaatgtgttaataccctgtatggataatgcttgacatttagtggtttccaaaatatattagtatattgttgaacatacattatgccttagaaatgcacattctgtattttgtgggatgataatctaattcagtatagaatatgctgtttggcaatgagtttgtggccagatttcaaatagggagttaagtggtactttcacaatccaaagatttttagttaaaaatcatgtagtctaatatgctgcagttatttttttatatttttcaatgcatttaattatcttttttataattctttgtactaactcagcatgtaacaaccaattta

SEQ ID NO: 11973 - DNA, 361 bp, Homo sapiens
gaattcgccctagagctgtatcatgtattttctttcaaattaactttgcttgcaattaagcttagggaaccagcaacaaaagcaaacttggcccgaggtcgttcaccgcgaaaatggattagagaaacttcttccccgatttaaggggaaagattcctgcggccagcgctttggggaaagtgccccgaccgcagaggcgacgacaggggagcaggaagctgctcacggtagtcggcgttggcggcagcggtggccttcctcatctgggcgatgtgggctccgagaagagtaaggataacatcctggaaatgacttctgtacggtttgagcccaactgcacactcatgacttggagctgccc

SEQ ID NO: 11974 - DNA, 184 bp, Homo sapiens
tgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctg

SEQ ID NO: 11975 - DNA, 279 bp, Homo sapiens
  misc_feature (40)..(40): n is a, c, g, or t
ggaagaaagtccttgtcctttgagactcagaaggccccangctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaa

SEQ ID NO: 11976 - DNA, 523 bp, Homo sapiens
tgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaac

SEQ ID NO: 11977 - DNA, 162 bp, Homo sapiens
  misc_feature (58)..(58): n is a, c, g, or t
  misc_feature (69)..(69): n is a, c, g, or t
  misc_feature (80)..(80): n is a, c, g, or t
aagccaattgccttagggtgggtcacaattcgacggtcatttgtgtgactgagtggtnagtgaccgtcncccctactggnactataagtgccttgagagcagccagcaggtttgtttctactctcggctggggctcagtagatgctccatagggaaataaaa

SEQ ID NO: 11978 - DNA, 564 bp, Homo sapiens
ccatgagcaacttccagagctggacaacttgggcctggatagcttttccagtggacctggggaagaggctttgttgcagatgagatcaaacatcatctatgactccactgcccgaatcagaaggaacgccaaaggaaactactgtaagaggaccccgctctacatcgacttcaaggagattgggtgggactcctggatcatcgctccgcctggatacgaagcctatgaatgccgtggtgtttgtaactaccccctggcagagcatctcacacccacaaagcatgcaattatccaggccttggtccacctcaagaattcccagaaagcttccaaagcctgctgtgtgcccacaaagctagagcccatctccatcctctatttagacaaaggcgtcgtcacctacaagtttaaatacgaaggcatggccgtctccgaatgtggctgtagatagaagaagagtcctatggcttatttaataactgtaaatgtgtatatttggtgttcctatttaatgagattatttaataagggtgtacagtaatagaggcttgctgccttcaggaa

SEQ ID NO: 11979 - DNA, 400 bp, Homo sapiens; identical to SEQ ID NO: 11817
  misc_feature (104)..(104): n is a, c, g, or t

SEQ ID NO: 11980 - DNA, 331 bp, Homo sapiens
gtgaatgtcttcctgaaaaccttaagagaaccaactggaaaacaaccagaaatgagagcatggagttaggcaaccgccgatctgctttctgtcactttgggcgagtttttcccgtcctgggatttcatatctctggaatcctgcagtacgtagccctctgtctggcttcctcgctccgtgtaatgttcttgagattcatccatgcagctgtgtatacctgcagtgattgtttctcttgttgattgctgagaagggttccatcgtatgccttttccagtttatttgttcatctgttgttagacatttgagttatttccagcttgggactctt

SEQ ID NO: 11981 - DNA, 455 bp, Homo sapiens
gtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacactttatacaaaaatgttaaaagcaggtttcctggcatgttctaaactgttttttctttaggaataaattacatttatctgcacagatgttgaaaatcctgttaaacccttgtca

SEQ ID NO: 11982 - DNA, 528 bp, Homo sapiens
ttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactgaagataacagccagggaggacaagcagggctgggcctagggacagactgcaagaggctcctgtcccctggggtctctgctgcatttgtgtcatcttgttgccatggagttgtgatcatcccatctaagctgcagcttcctgtcaacacttctcacatcttatgctaactgtagataaagtggtttgatggtgacttcctcgcctctcccaccccatgcattaaatttta

SEQ ID NO: 11983 - DNA, 461 bp, Homo sapiens
gttcagcctcggacttggaaacgtccgggttacaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagccccaagatggtgcaagggtctggctgctttgggaggaagatggaccggatcagctcctccagtggcctgggctgcaaagtgctgaggcggcattaagaggaagtcctggctgcagacacctgcttctgattccacaaggggctttttcctcaaccctgtggccgcctttgaagtgactcatttttttaatgtatttatgtatttatttgattgttttatataagatggtttcttacctttgagcacaaa

SEQ ID NO: 11984 - DNA, 420 bp, Homo sapiens
  misc_feature (318)..(318): n is a, c, g, or t
  misc_feature (381)..(381): n is a, c, g, or t
cggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcangcagaaatatgagatcaatgttctccgaaacaggatcaacgataaccagaaagtctccaaganccgcgggaaggctaaagtcaccgggcgctggaaatagag

SEQ ID NO: 11985 - DNA, 405 bp, Homo sapiens
aagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgaga

SEQ ID NO: 11986 - DNA, 532 bp, Homo sapiens
aaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttgaccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcggaagaacatcgatgcactgagtggaatggagggccgcaagaaaaagtttgagagctgagccttcctg
